US010233495B2

(12) United States Patent
Hatchwell et al.

(10) Patent No.: US 10,233,495 B2
(45) Date of Patent: Mar. 19, 2019

(54) METHODS AND COMPOSITIONS FOR SCREENING AND TREATING DEVELOPMENTAL DISORDERS

(71) Applicants: Population Bio, Inc., Melville, NY (US); The Hospital for Sick Children, Toronto (CA)

(72) Inventors: Eli Hatchwell, Winchester (GB); Peggy S. Eis, Fitchburg, WI (US); Stephen Scherer, Toronto (CA); Aparna Prasad, Rochester, NY (US)

(73) Assignees: THE HOSPITAL FOR SICK CHILDREN, Toronto (CA); POPULATION BIO, INC., Melville, NY (US)

(*) Notice: Subject to any disclaimer, the term of this patent is extended or adjusted under 35 U.S.C. 154(b) by 0 days.

(21) Appl. No.: 14/039,770

(22) Filed: Sep. 27, 2013

(65) Prior Publication Data
US 2014/0162894 A1 Jun. 12, 2014

Related U.S. Application Data

(60) Provisional application No. 61/744,463, filed on Sep. 27, 2012.

(51) Int. Cl.
C12Q 1/68 (2018.01)
C12P 19/34 (2006.01)
C12Q 1/6883 (2018.01)

(52) U.S. Cl.
CPC ...... *C12Q 1/6883* (2013.01); *C12Q 2600/112* (2013.01); *C12Q 2600/156* (2013.01)

(58) Field of Classification Search
CPC ............ C12Q 1/6883; C12Q 2600/156; C12Q 1/6874; C12Q 2600/136; G01N 33/6896; G01N 2500/04; G01N 2800/2835; G01N 2800/38; C12N 15/111
See application file for complete search history.

(56) References Cited

U.S. PATENT DOCUMENTS

| | | |
|---|---|---|
| 3,625,214 A | 12/1971 | Higuchi et al. |
| 4,683,195 A | 7/1987 | Mullis et al. |
| 4,789,734 A | 12/1988 | Pierschbacher |
| 4,897,268 A | 1/1990 | Tice et al. |
| 4,906,474 A | 3/1990 | Langer et al. |
| 4,925,673 A | 5/1990 | Steiner et al. |
| 4,992,445 A | 2/1991 | Lawter et al. |
| 5,001,139 A | 3/1991 | Lawter et al. |
| 5,023,252 A | 6/1991 | Hseih |
| 5,075,109 A | 12/1991 | Tice et al. |
| 5,143,854 A | 9/1992 | Pirrung et al. |
| 5,190,029 A | 3/1993 | Byron et al. |
| 5,223,409 A | 6/1993 | Ladner et al. |
| 5,272,071 A | 12/1993 | Chappel |
| 5,288,514 A | 2/1994 | Ellman |
| 5,376,359 A | 12/1994 | Johnson |
| 5,384,261 A | 1/1995 | Winkler et al. |
| 5,424,186 A | 6/1995 | Fodor et al. |
| 5,445,934 A | 8/1995 | Fodor et al. |
| 5,451,683 A | 9/1995 | Barrett et al. |
| 5,510,270 A | 4/1996 | Fodor et al. |
| 5,527,681 A | 6/1996 | Holmes et al. |
| 5,665,549 A | 9/1997 | Pinkel et al. |
| 5,700,637 A | 12/1997 | Southern |
| 5,744,305 A | 4/1998 | Fodor et al. |
| 5,776,434 A | 7/1998 | Purewal et al. |
| 5,811,128 A | 9/1998 | Tice et al. |
| 5,814,344 A | 9/1998 | Tice et al. |
| 5,820,883 A | 10/1998 | Tice et al. |
| 5,837,832 A | 11/1998 | Chee et al. |
| 5,853,763 A | 12/1998 | Tice et al. |
| 5,858,659 A | 1/1999 | Sapolsky et al. |
| 5,928,647 A | 7/1999 | Rock |
| 5,942,252 A | 8/1999 | Tice et al. |
| 5,945,334 A | 8/1999 | Besemer et al. |
| 6,040,138 A | 3/2000 | Lockhart et al. |
| 6,054,270 A | 4/2000 | Southern |
| 6,146,834 A | 11/2000 | Schaad et al. |
| 6,207,392 B1 | 3/2001 | Weiss et al. |
| 6,210,878 B1 | 4/2001 | Pinkel et al. |
| 6,251,607 B1 | 6/2001 | Tsen et al. |
| 6,300,063 B1 | 10/2001 | Lipshutz et al. |
| 6,423,499 B1 | 7/2002 | Song et al. |
| 6,429,027 B1 | 8/2002 | Chee et al. |
| 6,733,977 B2 | 5/2004 | Besemer et al. |

(Continued)

FOREIGN PATENT DOCUMENTS

| | | |
|---|---|---|
| CN | 1733937 A | 2/2006 |
| CN | 101148684 A | 3/2008 |

(Continued)

OTHER PUBLICATIONS

GeneCards output for ATXN2 gene, from www.genecards.ord, pritned on May 20, 2015, pp. 1-13.*
Human Genome CGH Microarrays—Details & Specifications, six printed pages from www.agilent.com, printed on May 20, 2015.*
McInnes et al. Molecular Autism 2010, 1:5, pp. 1-12.*
Lucentini, J. The Scientist, Dec. 20, 2004, p. 20.*
Juppner H, Bone vol. 17, No. 2, Supplement, Aug. 1995:39S-42S.*
Pennisi E. Science; Sep. 18, 1998; 281, 5384, pp. 1787-1789.*
Ching H. C. et al. International Journal of Oncology 39: 621-633, 2011.*
Pinto D. et al, Nature vol. 466 Jul. 15, 2010, p. 368-372. (Year: 2010).*

(Continued)

Primary Examiner — Stephen T Kapushoc
(74) Attorney, Agent, or Firm — Wilson Sonsini Goodrich & Rosati

(57) ABSTRACT

This document provides methods and materials related to genetic variations of developmental disorders. For example, this document provides methods for using such genetic variations to assess susceptibility of developing Autism Spectrum Disorder.

10 Claims, 11 Drawing Sheets
Specification includes a Sequence Listing.

(56) References Cited

U.S. PATENT DOCUMENTS

| | | |
|---|---|---|
| 6,858,394 B1 | 2/2005 | Chee et al. |
| 6,858,412 B2 | 2/2005 | Willis et al. |
| 6,892,141 B1 | 5/2005 | Nakae et al. |
| 6,916,621 B2 | 7/2005 | Shah |
| 6,951,761 B2 | 10/2005 | Star et al. |
| 6,969,589 B2 | 11/2005 | Patil et al. |
| 6,977,148 B2 | 12/2005 | Dean et al. |
| 7,011,949 B2 | 3/2006 | Amorese et al. |
| 7,014,997 B2 | 3/2006 | Knoll et al. |
| 7,030,231 B1 | 4/2006 | Craik et al. |
| 7,034,144 B2 | 4/2006 | Van Dongen et al. |
| 7,364,858 B2 | 4/2008 | Barany et al. |
| 7,424,368 B2 | 9/2008 | Huang et al. |
| 7,702,468 B2 | 4/2010 | Chinitz et al. |
| 7,957,913 B2 | 6/2011 | Chinitz et al. |
| 7,998,744 B2 | 8/2011 | Stevenson et al. |
| 8,367,417 B2 | 2/2013 | Stevenson et al. |
| 8,655,599 B2 | 2/2014 | Chinitz et al. |
| 8,862,410 B2 | 10/2014 | Hatchwell et al. |
| 2002/0012921 A1 | 1/2002 | Vincent, Jr. |
| 2002/0012930 A1 | 1/2002 | Rothberg et al. |
| 2003/0023070 A1 | 1/2003 | Ni et al. |
| 2003/0049663 A1 | 3/2003 | Wigler et al. |
| 2003/0068629 A1 | 4/2003 | Rothberg et al. |
| 2003/0082606 A1 | 5/2003 | Lebo et al. |
| 2003/0100102 A1 | 5/2003 | Rothberg et al. |
| 2003/0148344 A1 | 8/2003 | Rothberg et al. |
| 2003/0207295 A1 | 11/2003 | Gunderson et al. |
| 2003/0215821 A1 | 11/2003 | Gunderson et al. |
| 2004/0018491 A1 | 1/2004 | Gunderson et al. |
| 2004/0137473 A1 | 7/2004 | Wigler et al. |
| 2004/0157243 A1 | 8/2004 | Huang et al. |
| 2004/0197774 A1 | 10/2004 | Wigler et al. |
| 2004/0248161 A1 | 12/2004 | Rothberg et al. |
| 2005/0032095 A1 | 2/2005 | Wigler et al. |
| 2005/0037393 A1 | 2/2005 | Gunderson et al. |
| 2005/0037414 A1 | 2/2005 | Lee et al. |
| 2005/0079510 A1 | 4/2005 | Berka et al. |
| 2005/0100893 A1 | 5/2005 | Gunderson et al. |
| 2005/0100932 A1 | 5/2005 | Lapidus et al. |
| 2005/0112595 A1 | 5/2005 | Zhao et al. |
| 2005/0124022 A1 | 6/2005 | Srinivasan et al. |
| 2005/0196799 A1 | 9/2005 | Wigler et al. |
| 2005/0233339 A1 | 10/2005 | Barrett et al. |
| 2005/0266444 A1 | 12/2005 | Wigler et al. |
| 2005/0282196 A1 | 12/2005 | Costa |
| 2006/0012784 A1 | 1/2006 | Ulmer |
| 2006/0012793 A1 | 1/2006 | Harris |
| 2006/0024678 A1 | 2/2006 | Buzby |
| 2006/0024711 A1 | 2/2006 | Lapidus et al. |
| 2006/0063168 A1 | 3/2006 | Albertson et al. |
| 2006/0078909 A1 | 4/2006 | Srinivasan et al. |
| 2006/0134674 A1 | 6/2006 | Huang et al. |
| 2007/0141577 A1 | 6/2007 | Moore |
| 2007/0207481 A1 | 9/2007 | Wigler et al. |
| 2007/0259351 A1 | 11/2007 | Chinitz et al. |
| 2008/0131887 A1 | 6/2008 | Stephan et al. |
| 2009/0026082 A1 | 1/2009 | Rothberg et al. |
| 2009/0098547 A1 | 4/2009 | Ghosh |
| 2009/0127589 A1 | 5/2009 | Rothberg et al. |
| 2009/0304653 A1 | 12/2009 | Messier |
| 2010/0003685 A1 | 1/2010 | Aasly et al. |
| 2010/0028931 A1 | 2/2010 | Eggan et al. |
| 2010/0035252 A1 | 2/2010 | Rothberg et al. |
| 2010/0120046 A1 | 5/2010 | Brennan et al. |
| 2010/0137143 A1 | 6/2010 | Rothberg et al. |
| 2010/0167286 A1 | 7/2010 | Reijo Pera et al. |
| 2010/0188073 A1 | 7/2010 | Rothberg et al. |
| 2010/0197507 A1 | 8/2010 | Rothberg et al. |
| 2010/0227768 A1 | 9/2010 | Wigler et al. |
| 2010/0248236 A1 | 9/2010 | Chinitz et al. |
| 2011/0021366 A1 | 1/2011 | Chinitz et al. |
| 2011/0111014 A1 | 5/2011 | Langston |
| 2011/0130337 A1 | 6/2011 | Eriksson et al. |
| 2011/0264376 A1 | 10/2011 | Chinitz et al. |
| 2011/0311512 A1 | 12/2011 | Hakonarson et al. |
| 2012/0059594 A1 | 3/2012 | Hatchwell et al. |
| 2012/0100995 A1 | 4/2012 | Scherer et al. |
| 2013/0316911 A1 | 11/2013 | Scherer |
| 2014/0088882 A1 | 3/2014 | Chinitz et al. |
| 2014/0155271 A1 | 6/2014 | Hatchwell et al. |
| 2014/0161721 A1 | 6/2014 | Hatchwell et al. |
| 2014/0162933 A1 | 6/2014 | Hatchwell et al. |
| 2015/0051086 A1 | 2/2015 | Hatchwell et al. |
| 2016/0019336 A1 | 1/2016 | Chinitz et al. |

FOREIGN PATENT DOCUMENTS

| | | |
|---|---|---|
| CN | 101403008 A | 4/2009 |
| EP | 0373203 B1 | 8/1994 |
| EP | 0619321 A1 | 10/1994 |
| KR | 2009-0080105 A | 7/2009 |
| KR | 2011-0114664 A | 10/2011 |
| WO | WO 90/02809 A1 | 3/1990 |
| WO | WO 91/06667 A1 | 5/1991 |
| WO | WO 91/17271 A1 | 11/1991 |
| WO | WO 92/01047 A1 | 1/1992 |
| WO | WO 92/09690 A2 | 6/1992 |
| WO | WO 92/10092 A1 | 6/1992 |
| WO | WO 92/15679 A1 | 9/1992 |
| WO | WO 92/18619 A1 | 10/1992 |
| WO | WO 92/20791 A1 | 11/1992 |
| WO | WO 92/09690 A3 | 12/1992 |
| WO | WO 93/01288 A1 | 1/1993 |
| WO | WO 93/22684 A1 | 11/1993 |
| WO | WO 95/11995 A1 | 5/1995 |
| WO | WO 98/20019 A1 | 5/1998 |
| WO | WO 02/099129 A2 | 12/2002 |
| WO | WO 03/048318 A2 | 6/2003 |
| WO | WO 2004/018633 A2 | 3/2004 |
| WO | WO 2004/044225 A2 | 5/2004 |
| WO | WO 2004/075010 A2 | 9/2004 |
| WO | WO 2005/042763 A2 | 5/2005 |
| WO | WO 2005/068664 A2 | 7/2005 |
| WO | WO 2005/108997 A1 | 11/2005 |
| WO | WO 2004/044225 A3 | 4/2006 |
| WO | WO 2006/050475 A2 | 5/2006 |
| WO | WO 2007/070640 A2 | 6/2007 |
| WO | WO 2007/070640 A3 | 8/2007 |
| WO | WO 2007/129000 A2 | 11/2007 |
| WO | WO 2007/131135 A2 | 11/2007 |
| WO | WO 2008/016374 A2 | 2/2008 |
| WO | WO 2007/129000 A3 | 3/2008 |
| WO | WO 2007/131135 A3 | 11/2008 |
| WO | WO 2009/043178 A1 | 4/2009 |
| WO | WO 2009/073764 A1 | 6/2009 |
| WO | WO 2010/036353 A2 | 4/2010 |
| WO | WO 2010/056897 A1 | 5/2010 |
| WO | WO 2011/012672 A1 | 2/2011 |
| WO | WO 2011/035012 A2 | 3/2011 |
| WO | WO 2011/112961 A1 | 9/2011 |
| WO | WO 2012/023519 A2 | 3/2012 |
| WO | WO 2012/027491 A1 | 3/2012 |
| WO | WO 2012/047234 A1 | 4/2012 |
| WO | WO 2013/071119 A2 | 5/2013 |
| WO | WO-2013067451 A2 | 5/2013 |
| WO | WO 2014/043519 A1 | 3/2014 |

OTHER PUBLICATIONS

Kaminsky E.B. et al. Genet Med. Sep. 2011;13(9):777-84 (Published online ahead of print Aug. 12, 2011) (Year: 2011).*
Copy Number Variants summarry for 12q23.3-q24.13 from gene. sfari.org/database/cnv/, two pages printed on Dec. 2, 2017. (Year: 2017).*
U.S. Appl. No. 14/090,932, filed Nov. 26, 2013, Chinitz et al.
De Krom, et al. A common variant in DRD3 receptor is associated with autism spectrum disorder. Biol Psychiatry. Apr. 1, 2009;65(7):625-30. doi: 10.1016/j.biopsych.2008.09.035. Epub Dec. 5, 2008.
International search report and written opinion dated Jan. 15, 2014 for PCT/US2013/062346.
Knight, et al. A cytogenetic abnormality and rare coding variants identify ABCA13 as a candidate gene in schizophrenia, bipolar

(56) References Cited

OTHER PUBLICATIONS disorder, and depression. Am J Hum Genet. Dec. 2009;85(6):833-46. doi: 10.1016/j.ajhg.2009.11.003.
NCBI GenBank accession No. NG_12385.1. Mar. 27, 2012.
Bremer, et al. Copy number variation characteristics in subpopulations of patients with autism spectrum disorders. Am J Med Genet B Neuropsychiatr Genet. Mar. 2011;156(2):115-24. doi: 10.1002/ajmg.b.31142. Epub Dec. 8, 2010.
European search report and opinion dated Feb. 11, 2015 for EP Application No. 12839712.2.
Griswold, et al. A de novo 1.5 Mb microdeletion on chromosome 14q23.2-23.3 in a patient with autism and spherocytosis. Autism Res. Jun. 2011;4(3):221-7. doi: 10.1002/aur.186. Epub Feb. 28, 2011.
Marshall, et al. Structural variation of chromosomes in autism spectrum disorder. Am J Hum Genet. Feb. 2008;82(2):477-88. doi: 10.1016/j.ajhg.2007.12.009. Epub Jan. 17, 2008.
Pinto, et al. Comprehensive assessment of array-based platforms and calling algorithms for detection of copy number variants. Nat Biotechnol. May 8, 2011;29(6):512-20. doi: 10.1038/nbt.1852.
Sudhof. Neuroligins and neurexins link synaptic function to cognitive disease. Nature. Oct. 16, 2008;455(7215):903-11. doi: 10.1038/nature07456.
U.S. Appl. No. 13/648,874, filed Oct. 10, 2012, Scherer.
U.S. Appl. No. 13/763,550, filed Feb. 8, 2013, Hatchwell et al.
Agami, R. RNAi and related mechanisms and their potential use for therapy. Curr Opin Chem Biol. Dec. 2002;6(6):829-34.
Aitman, et al. Copy number polymorphism in Fcgr3 predisposes to glomerulonephritis in rats and humans. Nature. Feb. 16, 2006;439(7078):851-5.
Albertson, et al. Profiling breast cancer by array CGH. Breast Cancer Res Treat. Apr. 2003;78(3):289-98.
Altschul, et al. Gapped BLAST and PSI-BLAST: a new generation of protein database search programs. Nucleic Acids Res. Sep. 1, 1997;25(17):3389-402.
Amarzguioui, et al. Approaches for chemically synthesized siRNA and vector-mediated RNAi. FEBS Lett. Oct. 31, 2005;579(26):5974-81. Epub Sep. 20, 2005.
Ansel et al., Pharmaceutical Dosage Forms and Drug Delivery Systems (Lippencott Williams & Wilkins, Baltimore Md. (1999).
Arakawa, et al. Advances in characterization of neuroprotective peptide, humanin. Curr Med Chem. 2011;18(36):5554-63.
Ausubel (Ed.), Current Protocols in Molecular Biology (2007 John Wiley & Sons, NY).
Bailey, et al. Analysis of Segmental Duplications and Genome Assembly in the Mouse. Genome Res. 2004; 14:789-801.
Bakkaloglu, et al. Molecular cytogenetic analysis and resequencing of contactin associated protein-like 2 in autism spectrum disorders. Am J Hum Genet. Jan. 2008;82(1):165-73.
Bangham, et al. Diffusion of univalent ions across the lamellae of swollen phospholipids. J Mol Biol. Aug. 1965;13(1):238-52.
Bedell, et al. In vivo genome editing using a high-efficiency TALEN system. Nature. Sep. 23, 2012. doi: 10.1038/nature11537. [Epub ahead of print].
Bennett, C. Efficiency of antisense oligonucleotide drug discovery. Antisense Nucleic Acid Drug Dev. Jun. 2002;12(3):215-24.
Berkel, et al. Mutations in the SHANK2 synaptic scaffolding gene in autism spectrum disorder and mental retardation. Nat Genet. Jun. 2010;42(6):489-91. Epub May 16, 2010.
Bernstein, et al. Role for a bidentate ribonuclease in the initiation step of RNA interference. Nature. Jan. 18, 2001;409(6818):363-6.
Bier, et al. DNA microarrays. Adv Biochem Eng Biotechnol. 2008;109:433-53.
Biomarkers Definitions Working Group. Biomarkers and surrogate endpoints: preferred definitions and conceptual framework. Clin Pharmacol Ther. Mar. 2001;69(3):89-95.
Bochukova, et al. Large, rare chromosomal deletions associated with severe early-onset obesity. Nature. Feb. 4, 2010;463(7281):666-70. Epub Dec. 6, 2009.
Bodmer, et al. Common and rare variants in multifactorial susceptibility to common diseases. Nat Genet. Jun. 2008;40(6):695-701.
Bodzioch, et al. Evidence for potential functionality of nuclearly-encoded humanin isoforms. Genomics. Oct. 2009;94(4):247-56. Epub May 27, 2009.
Bosher, et al. RNA interference: genetic wand and genetic watchdog. Nat Cell Biol. Feb. 2000;2(2):E31-6.
Brummelkamp, et al. A system for stable expression of short interfering RNAs in mammalian cells. Science. Apr. 19, 2002;296(5567):550-3. Epub Mar. 21, 2002.
Bult, et al. The Mouse genome Database (MGD): mouse biology and model systems. Nucleic Acids Research. 2008; 36 Database Issue: D724-D728. doi:10.1093/nar/gkm961.
Chavanpatil, et al. Novel sustained release, swellable and bioadhesive gastroretentive drug delivery system for ofloxacin. Int J Pharm. Jun. 19, 2006;316(1-2):86-92. Epub Mar. 29, 2006.
Chen, et al. The evolution of gene regulation by transcription factors and microRNAs. Nat Rev Genet. Feb. 2007;8(2):93-103.
Chen, H. Clinical development of antisense oligonucleotides as anti-cancer therapeutics. Methods Mol Med. 2003;75:621-36.
Chi, et al. Genomewide view of gene silencing by small interfering RNAs. Proc Natl Acad Sci U S A. May 27, 2003;100(11):6343-6. Epub May 2, 2003.
Conrad, et al. Origins and functional impact of copy number variation in the human genome. Nature. Apr. 1, 2010;464(7289):704-12. Epub Oct. 7, 2009.
Cronin, et al. Analysis of genome-wide copy number variation in Irish and Dutch ALS populations. Hum Mol Genet. Nov. 1, 2008;17(21):3392-8. Epub Aug. 7, 2008.
Culture of Animal Cells: A Manual of Basic Technique by R. Ian Freshney, Publisher: Wiley-Liss; 5th edition (2005).
Dias, et al. Antisense oligonucleotides: basic concepts and mechanisms. Mol Cancer Ther. Mar. 2002;1(5):347-55.
Dibbens, et al. Familial and sporadic 15q13.3 microdeletions in Idiopathic Generalized Epilepsy: Precedent for Disorders with Complex Inheritance. Hum Mol Genet. Jul. 10, 2009. [Epub ahead of print].
Elbashir, et al. RNA interference is mediated by 21- and 22-nucleotide RNAs. Genes Dev. Jan. 15, 2001;15(2):188-200.
Encode project consortium, et al. An integrated encyclopedia of DNA elements in the human genome. Nature. Sep. 6, 2012;489(7414):57-74. doi: 10.1038/nature11247.
Estivill, et al. Copy number variants and common disorders: filling the gaps and exploring complexity in genome-wide association studies. PLoS Genet. Oct. 2007;3(10):1787-99.
Fan, et al. Illumina universal bead arrays. Methods Enzymol. 2006;410:57-73.
Fernandez, et al. Disruption of contactin 4 (CNTN4) results in developmental delay and other features of 3p deletion syndrome. Addendum. Am J Hum Genet. Jun. 2008;82(6):1385.
Fernandez, et al. Disruption of contactin 4 (CNTN4) results in developmental delay and other features of 3p deletion syndrome. Am J Hum Genet. Jun. 2004;74(6):1286-93.
Fire, et al. Potent and specific genetic interference by double-stranded RNA in Caenorhabditis elegans. Nature. Feb. 19, 1998;391(6669):806-11.
Freeman, et al. Copy number variation: new insights in genome diversity. Genome Res. Aug. 2006;16(8):949-61. Epub Jun. 29, 2006.
Galfre. et al. Antibodies to major histocompatibility antigens produced by hybrid cell lines. Nature. 1977; 266:550-52.
Gatto, et al. Genetic controls balancing excitatory and inhibitory synaptogenesis in neurodevelopmental disorder models. Frontiers in Synaptic Neuroscience. Jun. 2010; 2(4):1-19.
Gilling, et al. Breakpoint cloning and haplotype analysis indicate a single origin of the common Inv(10)(p11.2q21.2) mutation among northern Europeans. Am. J. Hum. Genet. 2006; 78(5):878-83.
Glessner, et al. Autism genome-wide copy number variation reveals ubiquitin and neuronal genes. Nature. May 28, 2009;459(7246):569-73. Epub Apr. 28, 2009.
Goldstein. Common genetic variation and human traits. N Engl J Med. Apr. 23, 2009;360(17):1696-8. Epub Apr. 15, 2009.

(56) References Cited

OTHER PUBLICATIONS

Gregoriadis. Chapter 14, "Liposomes," Drug Carriers in Biology and Medicine, pp. 2.sup.87-341 (Academic Press, 1979).
Gribble, et al. The complex nature of constitutional de novo apparently balanced translocations in patients presenting with abnormal phenotypes. J. Med. Genet. 2005; 42:8-16.
Griffiths, et al. Human anti-self antibodies with high specificity from phage display libraries. EMBO J. Feb. 1993;12(2):725-34.
Grskovic, et al. Induced pluripotent stem cells—opportunities for disease modelling and drug discovery. Nat Rev Drug Discov. Nov. 11, 2011;10(12):915-29. doi: 10.1038/nrd3577.
Harada, et al. Subtelomere specific microarray based comparative genomic hybridisation: a rapid detection system for cryptic rearrangements in idiopathic mental retardation. J. Med. Genet. 2004; 41:130-136.
Hatchwell, et al. High rate of submicroscopic human genomic polymorphism detected by array CGH. Proceedings of XIX International Genetics Congress. Melbourne, Australia. Abstracts and Posters. 2003; 1.E.0092. pp. 168 and 319.
Hay, et al. Bacteriophage cloning and *Escherichia coli* expression of a human IgM Fab. Hum Antibodies Hybridomas. Apr. 1992;3(2):81-5.
Helbig, et al. 15q13.3 microdeletions increase risk of idiopathic generalized epilepsy. Nat Genet. Feb. 2009;41(2):160-2. Epub Jan. 11, 2009.
Hicks et al., "Novel patterns of genome rearrangement and their association with survival in breast cancer," Genome Res 16:1465-1479, 2006.
Hoffman, et al. Pharmacokinetic and pharmacodynamic aspects of gastroretentive dosage forms. Int J Pharm. Jun. 11, 2004;277(1-2):141-53.
Hoheisel, J. Microarray technology: beyond transcript profiling and genotype analysis. Nat Rev Genet. Mar. 2006;7(3):200-10.
Huang, et al. Whole genome DNA copy number changes identified by high density oligonucleotide arrays. Hum Genomics. May 2004;1(4):287-99.
Hunter, C. Genetics: a touch of elegance with RNAi. Curr Biol. Jun. 17, 1999;9(12):R440-2.
Huse, et al. Generation of a large combinatorial library of the immunoglobulin repertoire in phage lambda. Science. Dec. 8, 1989;246(4935):1275-81.
Hutvagner, et al. A microRNA in a multiple-turnover RNAi enzyme complex. Science. Sep. 20, 2002;297(5589):2056-60. Epub Aug. 1, 2002.
Iafrate, et al. Detection of large-scale variation in the human genome. Nature Genet. 2004; 36:949-51.
International search report and written opinion dated Apr. 9, 2012 for PCT/US2011/001363.
International search report and written opinion dated Jun. 21, 2013 for PCT/IB2012/002498.
International search report and written opinion dated Jul. 3, 2013 for PCT/IB2012/002498.
International Search Report dated Sep. 11, 2008 for PCT Application No. US2007/68183.
Itsara, et al. Population analysis of large copy number variants and hotspots of human genetic disease. Am J Hum Genet. Feb. 2009;84(2):148-61. Epub Jan. 22, 2009.
Jorde, et al. Population genomics: a bridge from evolutionary history to genetic medicine. Hum. Mol. Genet. 2001; 10(20):2199-2207.
Kallioniemi, et al. Comparative genomic hybridization for molecular cytogenetic analysis of solid tumors. Science. Oct. 30, 1992;258(5083):818-21.
Karlin, et al. Applications and statistics for multiple high-scoring segments in molecular sequences. Proc Natl Acad Sci U S A. Jun. 15, 1993;90(12):5873-7.
Ketting, et al. Dicer functions in RNA interference and in synthesis of small RNA involved in developmental timing in C. elegans. Genes Dev. Oct. 15, 2001;15(20):2654-9.
Kim, et al. Strategies for silencing human disease using RNA interference. Nat Rev Genet. Mar. 2007;8(3):173-84.
Kim, et al. Synthetic dsRNA Dicer substrates enhance RNAi potency and efficacy. Nat Biotechnol. Feb. 2005;23(2):222-6. Epub Dec. 26, 2004.
Kimchi-Sarfaty, et al. A "silent" polymorphism in the MDR1 gene changes substrate specificity. Science. Jan. 26, 2007;315(5811):525-8. Epub Dec. 21, 2006.
Klausner, et al. Novel gastroretentive dosage forms: evaluation of gastroretentivity and its effect on levodopa absorption in humans. Pharm Res. Sep. 2003;20(9):1466-73.
Klein, et al. Comparative genomic hybridization, loss of heterozygosity, and DNA sequence analysis of single cells. Proc Natl Acad Sci U S A. Apr. 13, 1999;96(8):4494-9.
Kohler, et al. Continuous cultures of fused cells secreting antibody of predefined specificity. Nature. Aug. 7, 1975;256(5517):495-7.
Kozbor, et al. The production of monoclonal antibodies from human lymphocytes. Immunol. Today. 1983; 4(3): 72-79.
Kraus, et al. Detection and isolation of novel protein-tyrosine kinase genes employing reduced stringency hybridization. Methods Enzymol. 1991;200:546-56.
Kumar, et al. A de novo 1p34.2 microdeletion identifies the synaptic vesicle gene RIMS3 as a novel candidate for autism. J Med Genet. Jun. 21, 2009. [Epub ahead of print].
Kumar, et al. Recurrent 16p11.2 microdeletions in autism. Hum Mol Genet. Feb. 15, 2008;17(4):628-38. Epub Dec. 21, 2007.
Kurreck, J. Antisense technologies. Improvement through novel chemical modifications. Eur J Biochem. Apr. 2003;270(8):1628-44.
Kutyavin, et al. A novel endonuclease IV post-PCR genotyping system. Nucleic Acids Res. 2006;34(19):e128. Epub Sep. 29, 2006.
Lavery, et al. Antisense and RNAi: powerful tools in drug target discovery and validation. Curr Opin Drug Discov Devel. Jul. 2003;6(4):561-9.
Lerner, E. How to make a hybridoma. Yale J Biol Med. Sep.-Oct. 1981;54(5):387-402.
Maftei, et al. Interaction structure of the complex between neuroprotective factor humanin and Alzheimer's β-amyloid peptide revealed by affinity mass spectrometry and molecular modeling. J Pept Sci. Jun. 2012;18(6):373-82. doi: 10.1002/psc.2404. Epub Apr. 20, 2012.
Maniatis, et al. Molecular Cloning: A Laboratory Manual, Cold Spring Harbor Laboratory Press, Cold Spring Harbor, N.Y., USA (1982).
Manolio, et al. Finding the missing heritability of complex diseases. Nature. Oct. 8, 2009;461(7265):747-53.
Margulies, et al. Genome sequencing in microfabricated high-density picolitre reactors. Nature. Sep. 15, 2005;437(7057):376-80. Epub Jul. 31, 2005.
Marques, et al. A structural basis for discriminating between self and nonself double-stranded RNAs in mammalian cells. Nat Biotechnol. May 2006;24(5):559-65. Epub Apr. 30, 2006.
Martinez, et al. Single-stranded antisense siRNAs guide target RNA cleavage in RNAi. Cell. Sep. 6, 2002;110(5):563-74.
Mast, et al. Invader assay for single-nucleotide polymorphism genotyping and gene copy number evaluation. Methods Mol Biol. 2006;335:173-86. Abstract only.
Matsuoka, et al. Humanin and the receptors for humanin. Mol Neurobiol. Feb. 2010;41(1):22-8. Epub Dec. 9, 2009.
McCarroll, et al. Copy-number variation and association studies of human disease. Nat Genet. Jul. 2007;39(7 Suppl):S37-42.
McCarthy, et al. Microduplications of 16p11.2 are associated with schizophrenia. Nat Genet. Nov. 2009;41(11):1223-7. Epub Oct. 25, 2009.
McManus, et al. Gene silencing in mammals by small interfering RNAs. Nat Rev Genet. Oct. 2002;3(10):737-47.
Mockler, et al. Applications of DNA tiling arrays for whole-genome analysis. Genomics. Jan. 2005;85(1):1-15.
Nielsen, et al. Sequence-selective recognition of DNA by strand displacement with a thymine-substituted polyamide. Science. Dec. 6, 1991;254(5037):1497-500.
Nord, et al. Accurate and exact CNV identification from targeted high-throughput sequence data. BMC Genomics. Apr. 12, 2011;12:184.

(56) References Cited

OTHER PUBLICATIONS

Nykanen, et al. ATP requirements and small interfering RNA structure in the RNA interference pathway. Cell. Nov. 2, 2001;107(3):309-21.
Office action dated Jan. 6, 2011 for U.S. Appl. No. 12/707,561.
Office action dated Apr. 3, 2013 for U.S. Appl. No. 13/095,722.
Office action dated Jul. 17, 2013 for U.S. Appl. No. 12/449,566.
Office action dated Sep. 13, 2012 for Chinese Application No. 200780015873.8.
Office action dated Nov. 18, 2013 for U.S. Appl. No. 13/196,882.
Office action dated Dec. 16, 2008 for U.S. Appl. No. 11/421,348.
Office action dated Jun. 14, 2010 for UK Application No. GB0822081.6.
Office action dated Jun. 2, 2009 for U.S. Appl. No. 11/421,348.
Ozelius, et al. LRRK2 G2019S as a cause of Parkinson's disease in Ashkenazi Jews. N Engl J Med. Jan. 26, 2006;354(4):424-5.
Pang, et al. Towards a comprehensive structural variation map of an individual human genome. Genome Biol. 2010;11(5):R52. Epub May 19, 2010.
Peltz, et al. Targeting post-transcriptional control for drug discovery. RNA Biol. Jul.-Aug. 2009;6(3):329-34. Epub Jul. 7, 2009.
Perkel, J. SNP genotyping: six technologies that keyed a revolution. Nature Methods. 2008; 5:447-453.
Pinkel, et al. Comparative genomic hybridization. Annu. Rev. Genomics Hum. Genet. 2005; 6:331-54.
Pinkel, et al. High resolution analysis of DNA copy number variation using comparative genomic hybridization to microarrays. Nat Genet. Oct. 1998;20(2):207-11.
Pinto, et al. Functional impact of global rare copy number variation in autism spectrum disorders. Nature. Jul. 15, 2010;466(7304):368-72. Epub Jun. 9, 2010.
Plasterk, et al. The silence of the genes. Curr Opin Genet Dev. Oct. 2000;10(5):562-7.
Pollack, et al. Microarray analysis reveals a major direct role of DNA copy number alteration in the transcriptional program of human breast tumors. Proc. Natl. Acad. Sci. 2002; 99(20):12963-68.
Provost, et al. Ribonuclease activity and RNA binding of recombinant human Dicer. EMBO J. Nov. 1, 2002;21(21):5864-74.
Ramsey, et al. A CFTR potentiator in patients with cystic fibrosis and the G551D mutation. N Engl J Med. Nov. 3, 2011;365(18):1663-72.
Raqoussis, et al. Affymetrix GeneChip system: moving from research to the clinic. Expert Rev Mol Diagn. Mar. 2006;6(2):145-52.
Redon, et al. Global variation in copy number in the human genome. Nature. Nov. 23, 2006;444(7118):444-54.
Rees, et al. Isoform heterogeneity of the human gephyrin gene (GPHN), binding domains to the glycine receptor, and mutation analysis in hyperekplexia. J Biol Chem. Jul. 4, 2003;278(27):24688-96. Epub Apr. 8, 2003.
Remington "The Science and Practice of Pharmacy" (20th Ed., Lippincott Williams & Wilkins, Baltimore MD).
Reynold, et al. Rational siRNA design for RNA interference. Nat Biotechnol. Mar. 2004;22(3):326-30. Epub Feb. 1, 2004.
Risch, et al. A genomic screen of autism: evidence for a multilocus etiology. Am J Hum Genet. Aug. 1999;65(2):493-507.
Rodriguez-Revenga, et al. Structural variation in the human genome: the impact of copy number variants on clinical diagnosis. Genet Med. Sep. 2007;9(9):600-6.
Roohi, et al. Disruption of contactin 4 in three subjects with autism spectrum disorder. J Med Genet. Mar. 2009;46(3):176-82.
Saha, et al. Technical challenges in using human induced pluripotent stem cells to model disease. Cell Stem Cell. Dec. 4, 2009;5(6):584-95.
Sambrook et al., Molecular Cloning: A Laboratory Manual (2 ed.), Cold Spring Harbor Laboratory Press, Cold Spring Harbor, N.Y., USA (1989).
Schule, et al. Can cellular models revolutionize drug discovery in Parkinson's disease? Biochim Biophys Acta. Nov. 2009;1792(11):1043-51. Epub Sep. 3, 2009.
Schwarz, et al. Asymmetry in the assembly of the RNAi enzyme complex. Cell. Oct. 17, 2003;115(2):199-208.
Sebat, et al. Large-scale copy number polymorphism in the human genome. Science. 2004; 305(5683):525-8.
Sebat, et al. Strong association of de novo copy number mutations with autism. Science. Apr. 20, 2007;316(5823):445-9.
Sharp, P. RNA interference—2001. Genes Dev. Mar. 1, 2001;15(5):485-90.
Shi, Y. Mammalian RNAi for the masses. Trends Genet. Jan. 2003;19(1):9-12.
Shuey, et al. RNAi: gene-silencing in therapeutic intervention. Drug Discov Today. Oct. 15, 2002;7(20):1040-6.
Siolas, et al. Synthetic shRNAs as potent RNAi triggers. Nat Biotechnol. Feb. 2005;23(2):227-31. Epub Dec. 26, 2004.
Smith, et al. A high-density admixture map for disease gene discovery in african americans. Am J Hum Genet. May 2004;74(5):1001-13. Epub Apr. 14, 2004.
Snijders, et al. Assembly of microarrays for genome-wide measurement of DNA copy number. Nat Genet. Nov. 2001;29(3):263-4.
Snijders, et al. BAC microarray-based comparative genomic hybridization. Methods Mol Biol. 2004;256:39-56.
Snijders, et al. Mapping segmental and sequence variations among laboratory mice using BAC array CGH. Genome Res. Feb. 2005;15(2):302-11.
Soni, et al. Progress toward ultrafast DNA sequencing using solid-state nanopores. Clin Chem. Nov. 2007;53(11):1996-2001. Epub Sep. 21, 2007.
Stefansson, et al. Large recurrent microdeletions associated with schizophrenia. Nature. Sep. 11, 2008;455(7210):232-6.
Stephens, et al. Antisense oligonucleotide therapy in cancer. Curr Opin Mol Ther. Apr. 2003;5(2):118-22.
Streubel, et al. Gastroretentive drug delivery systems. Expert Opin Drug Deliv. Mar. 2006;3(2):217-33.
Summary of NRSP-8 Accomplishments: 2003-2008. Available at http://www.lgu.umd.edu/lgu_v2/pages/attachs/9956_Attach1%20%202003-08%20ACCOMPLISHMENTS.doc. Published on Feb. 9, 2008. (6 pages).
Szoka, et al. Procedure for preparation of liposomes with large internal aqueous space and high capture by reverse-phase evaporation. Proc Natl Acad Sci U S A. Sep. 1978;75(9):4194-8.
Tabara, et al. The dsRNA binding protein RDE-4 interacts with RDE-1, DCR-1, and a DExH-box helicase to direct RNAi in C. elegans. Cell. Jun. 28, 2002;109(7):861-71.
Tabuchi, et al. A neuroligin-3 mutation implicated in autism increases inhibitory synaptic transmission in mice. Science. Oct. 5, 2007;318(5847):71-6. Epub Sep. 6, 2007.
Teo, et al. Statistical challenges associated with detecting copy number variations with next-generation sequencing. Bioinformatics. Aug. 31, 2012.
The International Schizophrenia Consortium. Rare chromosomal deletions and duplications increase risk of schizophrenia. Nature. Sep. 11, 2008;455(7210):237-41. Epub Jul. 30, 2008.
The Merck Manual of Diagnosis and Therapy, 18th Edition, published by Merck Research Laboratories, 2006 (ISBN 0-911910-18-2).
Thompson. Applications of antisense and siRNAs during preclinical drug development. Drug Discov Today. Sep. 1, 2002;7(17):912-7.
Urnov, et al. Genome editing with engineered zinc finger nucleases. Nat Rev Genet. Sep. 2010;11(9):636-46.
Van Goor, et al. Correction of the F508del-CFTR protein processing defect in vitro by the investigational drug VX-809. Proc Natl Acad Sci U S A. Nov. 15, 2011;108(46):18843-8. Epub Oct. 5, 2011.
Van Goor, et al. Rescue of CF airway epithelial cell function in vitro by a CFTR potentiator, VX-770. Proc Natl Acad Sci U S A. Nov. 3, 2009;106(44):18825-30. Epub Oct. 21, 2009.
Veensra-Vanderweele, et al. Networking in autism: leveraging genetic, biomarker and model system findings in the search for new treatments. Neuropsychopharmacology. Jan. 2012;37(1):196-212. doi: 10.1038/npp.2011.185. Epub Sep. 21, 2011.
Vickers, et al. Efficient reduction of target RNAs by small interfering RNA and RNase H-dependent antisense agents. A comparative analysis. J Biol Chem. Feb. 28, 2003;278(9):7108-18. Epub Dec. 23, 2002.

(56) References Cited

OTHER PUBLICATIONS

Vissers, et al. Array-based comparative genomic hybridization for the genomewide detection of submicroscopic chromosomal abnormalities. Am. J. Hum. Genet. 2003; 73:1261-70.
Vissers, et al. Identification of disease genes by whole genome CGH arrays. Hum Mol Genet. Oct. 15, 2005;14 Spec No. 2:R215-223.
Walsh, et al. Detection of inherited mutations for breast and ovarian cancer using genomic capture and massively parallel sequencing. Proc Natl Acad Sci U S A. Jul. 13, 2010;107(28):12629-33. Epub Jun. 28, 2010.
Walsh, et al. Spectrum of mutations in BRCA1, BRCA2, CHEK2, and TP53 in families at high risk of breast cancer. JAMA. Mar. 22, 2006;295(12):1379-88.
Walters, et al. A new highly penetrant form of obesity due to deletions on chromosome 16p11.2. Nature. Feb. 4, 2010;463(7281):671-5.
Wang, et al. Antisense anticancer oligonucleotide therapeutics. Curr Cancer Drug Targets. Nov. 2001;1(3):177-96.
Weiss, et al. Association between microdeletion and microduplication at 16p11.2 and autism. N Engl J Med. Feb. 14, 2008;358(7):667-75.
Westmark, C. What's hAPPening at synapses? The role of amyloid β-protein precursor and β-amyloid in neurological disorders. Mol Psychiatry. Aug. 28, 2012. doi: 10.1038/mp.2012.122.
Wilson, et al. DNA copy-number analysis in bipolar disorder and schizophrenia reveals aberrations in genes involved in glutamate signaling. Hum Mol Genet. Mar. 1, 2006;15(5):743-9. Epub Jan. 24, 2006.
Xia, et al. siRNA-mediated gene silencing in vitro and in vivo. Nat Biotechnol. Oct. 2002;20(10):1006-10. Epub Sep. 16, 2002.
Xie, et al. CNV-seq, a new method to detect copy number variation using high-throughput sequencing. BMC Bioinformatics. Mar. 6, 2009;10:80.
Yusa, et al. Targeted gene correction of α1-antitrypsin deficiency in induced pluripotent stem cells. Nature. Oct. 12, 2011;478(7369):391-4. doi: 10.1038/nature10424.
Zapala, et al. Humanins, the neuroprotective and cytoprotective peptides with antiapoptotic and anti-inflammatory properties. Pharmacol Rep. Sep.-Oct. 2010;62(5):767-77.
Zhang, et al. Copy number variation in human health, disease, and evolution. Annu Rev Genomics Hum Genet. 2009;10:451-81.
Zhang, et al. Detection of copy number variation from array intensity and sequencing read depth using a stepwise Bayesian model. BMC Bioinformatics. Oct. 31, 2010;11:539.
Betancur, et al. The emerging role of synaptic cell-adhesion pathways in the pathogenesis of autism spectrum disorders. Trends Neurosci. Jul. 2009;32(7):402-12. doi: 10.1016/j.tins.2009.04.003. Epub Jun. 21, 2009.
Office action dated Dec. 16, 2014 for U.S. Appl. No. 12/449,566.
U.S. Appl. No. 14/449,217, filed Aug. 1, 2014, Hatchwell et al.
Notice of allowance dated Jul. 25, 2014 for U.S. Appl. No. 13/196,882.
Office action dated May 28, 2014 for U.S. Appl. No. 12/449,566.
U.S. Appl. No. 14/806,131, filed Jul. 22, 2015, Chinitz et al.
Abravaya, et al. Detection of point mutations with a modified ligase chain reaction (Gap-LCR). Nucleic Acids Research. 1995;23(4):675-682.
Bernard, et al. Sequence of the murine and human cellular myc oncogenes and two modes of myc transcription resulting from chromosome translocation in B lymphoid tumours. EMBO J. 1983;2(12):2375-83.
Dijkhuizen, et al. FISH and array-CGH analysis of a complex chromosome 3 aberration suggests that loss of CNTN4 and CRBN contributes to mental retardation in 3pter deletions. Am J Med Genet A. Nov. 15, 2006;140(22):2482-7.
Fernandez, et al. Gene Discovery in Developmental Neuropsychiatric Disorders: Clues from Chromosomal Rearrangements. Yale Journal of Biology and Medicine, vol. 78 (2005), pp. 95-130. on p. 103. Abstract.

Gelmann, et al. Identification of reciprocal translocation sites within the c-myc oncogene and immunoglobulin mu locus in a Burkitt lymphoma. Nature. Dec. 22, 1983-Jan. 4, 1984;306(5945):799-803.
Guatelli, et al. Isothermal, in vitro amplification of nucleic acids by a multienzyme reaction modeled after retroviral replication. Proc Natl Acad Sci U S A. Mar. 1990;87(5):1874-8.
Kwoh, et al. Transcription-based amplification system and detection of amplified human immunodeficiency virus type 1 with a bead-based sandwich hybridization format. Proc Natl Acad Sci U S A. Feb. 1989;86(4):1173-7.
Landegren, et al. A ligase-mediated gene detection technique. Science. Aug. 26, 1988;241(4869):1077-80.
Lizardi, et al. Exponential amplification of recombinant-RNA hybridization probes. Nature Biotechnology 6.10 (1988): 1197-1202.
Mohapatra, et al. Analyses of brain tumor cell lines confirm a simple model of relationships among fluorescence in situ hybridization, DNA index, and comparative genomic hybridization. Genes Chromosomes Cancer. Dec. 1997;20(4):311-9.
Nakazawa, et al. UV and skin cancer: specific p53 gene mutation in normal skin as a biologically relevant exposure measurement. Proc Natl Acad Sci U S A. Jan. 4, 1994;91(1):360-4.
Office action dated Sep. 2, 2015 for U.S. Appl. No. 12/449,566.
Petrini, et al. The immunoglobulin heavy chain switch: structural features of gamma 1 recombinant switch regions. J Immunol Mar. 15, 1987;138(6):1940-6.
Saiki, et al. Primer-directed enzymatic amplification of DNA with a thermostable DNA polymerase. Science. Jan. 29, 1988;239(4839):487-91.
European search report dated Oct. 14, 2015 for EP Application No. 13746934.2.
Calvo, et al. High-throughput, pooled sequencing identifies mutations in NUBPL and FOXRED1 in human complex I deficiency. Nat Genet. Oct. 2010;42(10):851-8. Epub Sep. 5, 2010.
Gagneux, et al. Genetic differences between humans and great apes. Mol Phylogenet Evol. Jan. 2001;18(1):2-13.
GeneCards output for DIAPH2 gene, from www.genecards.ord, printed on Jun. 11, 2015, pp. 1-11.
GPHN Gene—GeneCards output. pp. 1-14. Printed on Jul. 2, 2015 from www.genecards.org.
Hattersley, et al. What makes a good genetic association study? Lancet. Oct. 8, 2005;366(9493):1315-23.
Hegele. SNP judgments and freedom of association. Arterioscler Thromb Vasc Biol. Jul. 1, 2002;22(7):1058-61.
Hirschhorn, et al. A comprehensive review of genetic association studies. Genet Med. Mar.-Apr. 2002;4(2):45-61.
International search report and written opinion dated Jan. 20, 2014 for PCT/US2013/059739.
International search report and written opinion dated Apr. 22, 2013 for PCT/US2012/063451.
Mummidi, et al. Evolution of human and non-human primate CC chemokine receptor 5 gene and mRNA. Potential roles for haplotype and mRNA diversity, differential haplotype-specific transcriptional activity, and altered transcription factor binding to polymorphic nucleotides in the pathogenesis of HIV-1 and simian immunodeficiency virus. J Biol Chem. Jun. 23, 2000;275(25):18946-61.
Nalls, et al. Extended tracts of homozygosity identify novel candidate genes associated with late-onset Alzheimer's disease. Neurogenetics. Jul. 2009;10(3):183-90. doi: 10.1007/s10048-009-0182-4. Epub Mar. 7, 2009.
Nalls, et al. Imputation of sequence variants for identification of genetic risks for Parkinson's disease: a meta-analysis of genome-wide association studies. Lancet. Feb. 19, 2011;377(9766):641-9. doi: 10.1016/S0140-6736(10)62345-8. Epub Feb. 1, 2011.
NCBI GenBank accession No. NM_207303.1. Apr. 20, 2004.
NCBI. GenBank accession No. AL390798.3. Human chromosome 14 DNA sequence BAC R-21O19 of library RPCI-11 from chromosome 14 of *Homo sapiens* (Human), complete sequence. Apr. 28, 2011.
Office action dated Jun. 23, 2015 for U.S. Appl. No. 13/763,550.
Office action dated Jun. 29, 2015 for U.S. Appl. No. 14/026,642.
Office action dated Jul. 9, 2015 for U.S. Appl. No. 13/648,874.
Office action dated Aug. 4, 2015 for U.S. Appl. No. 13/668,049.
Office action dated Oct. 3, 2014 for U.S. Appl. No. 13/668,049.

(56) References Cited

OTHER PUBLICATIONS

Schapira, et al. Mitochondrial complex I deficiency in Parkinson's disease. Lancet. Jun. 3, 1989;1(8649):1269.
Schapira. Causes of neuronal death in Parkinson's disease. Adv Neurol. 2001;86:155-62.
Schapira. Mitochondrial complex I deficiency in Parkinson's disease. Adv Neurol. 1993;60:288-91.
Simon-Sanchez, et al. Genome-wide association study reveals genetic risk underlying Parkinson's disease. Nat Genet. Dec. 2009;41(12):1308-12. doi: 10.1038/ng.487. Epub Nov. 15, 2009. with supplemental information.
Stark, et al. De novo 325 kb microdeletion in chromosome band 10q25.3 including ATRNL1 in a boy with cognitive impairment, autism and dysmorphic features. Eur J Med Genet. Sep.-Oct. 2010;53(5):337-9. doi: 10.1016/j.ejmg.2010.07.009. Epub Jul. 27, 2010.
Thorpe, et al. Improved antitumor effects of immunotoxins prepared with deglycosylated ricin A-chain and hindered disulfide linkages. Cancer Res. Nov. 15, 1988;48(22):6396-403.
Vaughan, et al. Genetics of Parkinsonism: a review. Ann Hum Genet. Mar. 2001;65(Pt 2):111-26.
Walker, et al. Genetic analysis of attractin homologs. Genesis. 2007; 45(12):744-756.
Daruwala, et al. A versatile statistical analysis algorithm to detect genome copy number variation. Proc Natl Acad Sci U S A. Nov. 16, 2004;101(46):16292-7. Epub Nov. 8, 2004.
European search report and opinion dated Feb. 27, 2015 for EP Application No. 11814903.8.
European search report and opinion dated Jun. 9, 2015 for EP Application No. 12846660.4.
Alexander Zimprich, et al., A mutation in, encoding a subunit of the retromer complex, causes late-onset parkinson disease, American journal of human genetics, American society of human genetics. Jun. 2011; 89(1):168-175.
Carles Vilario-Guell, et al., Mutations in Parkinson disease, American journal of human genetics, american society of human genetics. Jun. 2011; 89(1):162-167.
Co-pending U.S. Appl. No. 15/279,012, filed Sep. 28, 2016.
Corti, et al. What Genetics tells us about the causes and mechanisms of parkinson's disease. Physiological reviews.Oct. 2011; 91(4): 1161-1218.
European Search Report dated Sep. 2, 2016 for European Application No. 13836501.0.
"Introducing Genome-Wide SNP Array 6.0 Pure performance & Genetic Power." May 21, 2008. Available at http://www.genehk.com/news/doc/Genomics_genome-wide Human SNP Array 6.0.pdf. Accessed on Dec. 22, 2016.
Kumar Kishore, et al., Genetics of parkinson disease and other movement disorders, Current opinion in neurology, Aug. 2012; 25(4):466-474.
Latchman, et al. Viral vectors for gene therapy in Parkinson's disease. Rev Neurosci. 2001;12(1):69-78.
Lucentini, et al. Gene association studies typically wrong. Reproducible gene-disease associations are few and far between. The Scientist. 2004; 18(24):20.
Office Action dated Feb. 24, 2016 for U.S. Appl. No. 14/039,770.
Office Action dated May 27, 2015 for U.S. Appl. No. 14/039,770.
UK Parkinson's Disease Consortium et al., Dissection of the genetics of parkinson's disease identifies an additional association 5' of SNCA and multiple associated haplotypes at 17q21. Human Molecular genetics. Jan. 15, 2011; 20(2): 345-353.
Office Action dated Sep. 15, 2016 for U.S. Appl. No. 13/763,550.
Office Action dated Oct. 19, 2016 for European Application No. 12846660.4.
Office Action dated Dec. 6, 2016 for U.S. Appl. No. 14/026,642.
Office action dated Feb. 9, 2011 for UK Application No. GB0822081.6.
Paisan-Ruiz Coro, et al., Parkinson's disease and low frequency alleles foung together throughout LRRK2, Annals of human genetics. Jul. 2009. 73(4). 391-403.
Crespi, et al. Association testing of copy number variants in schizophrenia and autism spectrum disorders. J Neurodev Disord. May 30, 2012;4(1):15. doi: 10.1186/1866-1955-4-15.
European search report dated Apr. 11, 2016 for EP Application No. 13840476.9.
Guilmatre, et al. Recurrent rearrangements in synaptic and neurodevelopmental genes and shared biologic pathways in schizophrenia, autism, and mental retardation. Arch Gen Psychiatry. Sep. 2009;66(9):947-56. doi: 10.1001/archgenpsychiatry.2009.80.
He, et al. Analysis of de novo copy number variations in a family affected with autism spectrum disorders using high-resolution array-based comparative genomic hybridization. Zhonghua Yi Xue Yi Chuan Xue Za Zhi. Jun. 2012;29(3):266-9. doi: 10.3760/cma.j.issn.1003-9406.2012.03.004. English abstract only.
Office action dated Feb. 25, 2016 for U.S. Appl. No. 13/648,874.
Office action dated Feb. 29, 2016 for U.S. Appl. No. 14/026,642.
Office action dated Mar. 1, 2016 for U.S. Appl. No. 13/763,550.
Office action dated May 17, 2016 for U.S. Appl. No. 14/090,932.
Office action dated Jun. 28, 2016 for U.S. Appl. No. 12/449,566.
O'Keefe, et al. High-resolution genomic arrays facilitate detection of novel cryptic chromosomal lesions in myelodysplastic syndromes. Exp Hematol. Feb. 2007;35(2):240-51.
Prasad, et al. A discovery resource of rare copy number variations in individuals with autism spectrum disorder. G3 (Bethesda). Dec. 2012;2(12):1665-85. doi: 10.1534/g3.112.004689. Epub Dec. 1, 2012.
Tam, et al. The role of DNA copy number variation in schizophrenia. Biol Psychiatry. Dec. 1, 2009;66(11):1005-12. doi: 10.1016/j.biopsych.2009.07.027. Epub Sep. 12, 2009.
Ziats, et al. Expression profiling of autism candidate genes during human brain development implicates central immune signaling pathways. PLoS One. 2011;6(9):e24691. doi: 10.1371/journal.pone.0024691. Epub Sep. 15, 2011.
Liu, Qing-Rong, et al. "Addiction molecular genetics: 639,401 SNP whole genome association identifies many "cell adhesion" genes." American Journal of Medical Genetics Part B: Neuropsychiatric Genetics val. 141 (2006): pp. 918-925.
Office Action dated Apr. 13, 2017 for U.S. Appl. No. 13/648,874.
Office Action dated May 25, 2017 for U.S. Appl. No. 13/763,550.
Office Action dated Aug. 11, 2017 for U.S. Appl. No. 14/026,642.
Purcell et al. "Postmortem brain abnormalities of the glutamate neurotransmitter system in autism" (Neurology, vol. 57 (2001) pp. 1618-1628).
Zeng, Li, et al. "A novel splice variant of the cell adhesion molecule contactin 4 (CNTN4) is mainly expressed in human brain." Journal of human genetics val. 47 (2002): pp. 497-499.
Langston, et al., Multisystem Lewy body disease and the other parkinsonian disorders. Nature Genetics. Dec. 2015; 47(12):1378-1385.
Poewe, et al., Parkinson disease. Nature Review:Disease Primers. Mar. 23, 2017.vol. 3, Article 17013: 1-21.
CNV: 14q23.3 summary output from https://gene.sfari.org/database/cnv/14q23.3 Nov. 30, 2017, pp. 1-3. (year: 2017).
Office Action dated Oct. 10, 2017 for U.S. Appl. No. 14/449,217.
Office Action dated Oct. 13, 2017 for U.S. Appl. No. 14/806,131.
Office Action dated Dec. 5, 2017 for U.S. Appl. No. 13/648,874.
Office Action dated Dec. 11, 2017 for U.S. Appl. No. 13/763,550.
Office Action dated Dec. 29, 2017 for U.S. Appl. No. 13/668,049.
Sanders, et al., Multiple Recurrent De Novo CNVs, including duplications of the 7q11.23 Williams Syndrome Region, Are Strongly Associated with Autism. Neuron. Jun. 9, 2011; 70: 863-885.
NCBI SNP Database rs201412882, ss491686165, Mar. 6, 2012 (National Library of Medicine, NIH, Bethesda, MD, USA).
Notice of Allowance dated Jan. 11, 2018 for U.S. Appl. No. 14/026,642.

* cited by examiner

METHODS AND COMPOSITIONS FOR SCREENING AND TREATING DEVELOPMENTAL DISORDERS

CROSS REFERENCE

This application claims benefit of U.S. Provisional Application No. 61/744,463, filed Sep. 27, 2012, which application is incorporated herein by reference in its entirety.

REFERENCE TO A SEQUENCE LISTING

The instant application includes a sequence listing. A compact disc labeled "COPY 1 of 3" contains a computer readable form of the Sequence Listing file named ASD_20130923_ST25.txt. The Sequence Listing is 608,686,080 bytes in size and was recorded on Sep. 24, 2013. The compact disc is 1 of 3 compact discs. Duplicate copies of the compact disc are labeled "COPY 2 of 3," and "COPY 3 of 3." The compact disc and duplicate copies are identical and are hereby incorporated by reference in their entirety.

BACKGROUND OF THE DISCLOSURE

Genetic risk can be conferred by subtle differences in individual genomes within a population. Genes can differ between individuals due to genomic variability, the most frequent of which are due to single nucleotide polymorphisms (SNPs). SNPs can be located, on average, every 500-1000 base pairs in the human genome. Additional genetic polymorphisms in a human genome can be caused by duplication, insertion, deletion, translocation and/or inversion, of short and/or long stretches of DNA. Thus, in general, genetic variability among individuals occurs on many scales, ranging from single nucleotide changes, to gross changes in chromosome structure and function. Recently, many copy number variations (CNVs) of DNA segments, including deletions, insertions, duplications, amplifications, and complex multi-site variants, ranging in length from kilobases to megabases in size, have been discovered (Redon, R. et al. Nature 444:444-54 (2006) and Estivill, X. & Armengol, L. PLoS Genetics 3(10): e190 (2007)). To date, known CNVs account for over 15% of the assembled human genome (Estivill, X. Armengol, L. PLoS Genetics 3(10): e190 (2007)). However, a majority of these variants are extremely rare and cover a small percentage of a human genome of any particular individual.

Today, it is estimated that one in every 88 children is diagnosed with Autism Spectrum Disorder (ASD) according to the CDC, making it more common than childhood cancer, juvenile diabetes and pediatric AIDS combined. An estimated 1.5 million individuals in the U.S. and tens of millions worldwide are affected by autism. Government statistics suggest the prevalence rate of autism is increasing 10-17 percent annually. There is no established explanation for this increase, although improved screening and environmental influences are two reasons often considered. Studies suggest boys are five times more likely than girls to develop autism and receive the screening three to four times more frequently. Current estimates are that in the United States alone, one out of 54 boys is diagnosed with autism. ASD can be characterized by problems and symptoms in the following areas: communication, both verbal and non-verbal, such as pointing, eye contact, and smiling; social, such as sharing emotions, understanding how others think and feel, and holding a conversation; and routines or repetitive behaviors (also called stereotyped behaviors), such as repeating words or actions, obsessively following routines or schedules, and playing in repetitive ways. As genetic variations conferring risk to developmental disorders, including ASD, are uncovered, genetic testing can play a role for clinical therapeutics.

Despite these advances towards an understanding of the etiology of developmental disorders, a large fraction of the genetic contribution to these disorders remains undetermined Identification of underlying genetic variants that can contribute to developmental disorder pathogenesis can aid in the screening and identification of individuals at risk of developing these disorders and can be useful for disease management. There is a need to identify new treatments for developmental disorders, specifically ASD, and the identification of novel genetic risk factors and causes can assist in the development of potential therapeutics and agents. There is also a need for improved assays for predicting and determining potential treatments and their effectiveness.

INCORPORATION BY REFERENCE

All publications, patents, and patent applications mentioned in this specification are herein incorporated by reference to the same extent as if each individual publication, patent, or patent application was specifically and individually indicated to be incorporated by reference. In the event of a conflict between a term herein and a term incorporated by reference, the term herein controls.

BRIEF DESCRIPTION OF THE DRAWINGS

The novel features of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings.

SUMMARY OF THE INVENTION

Figure 1:
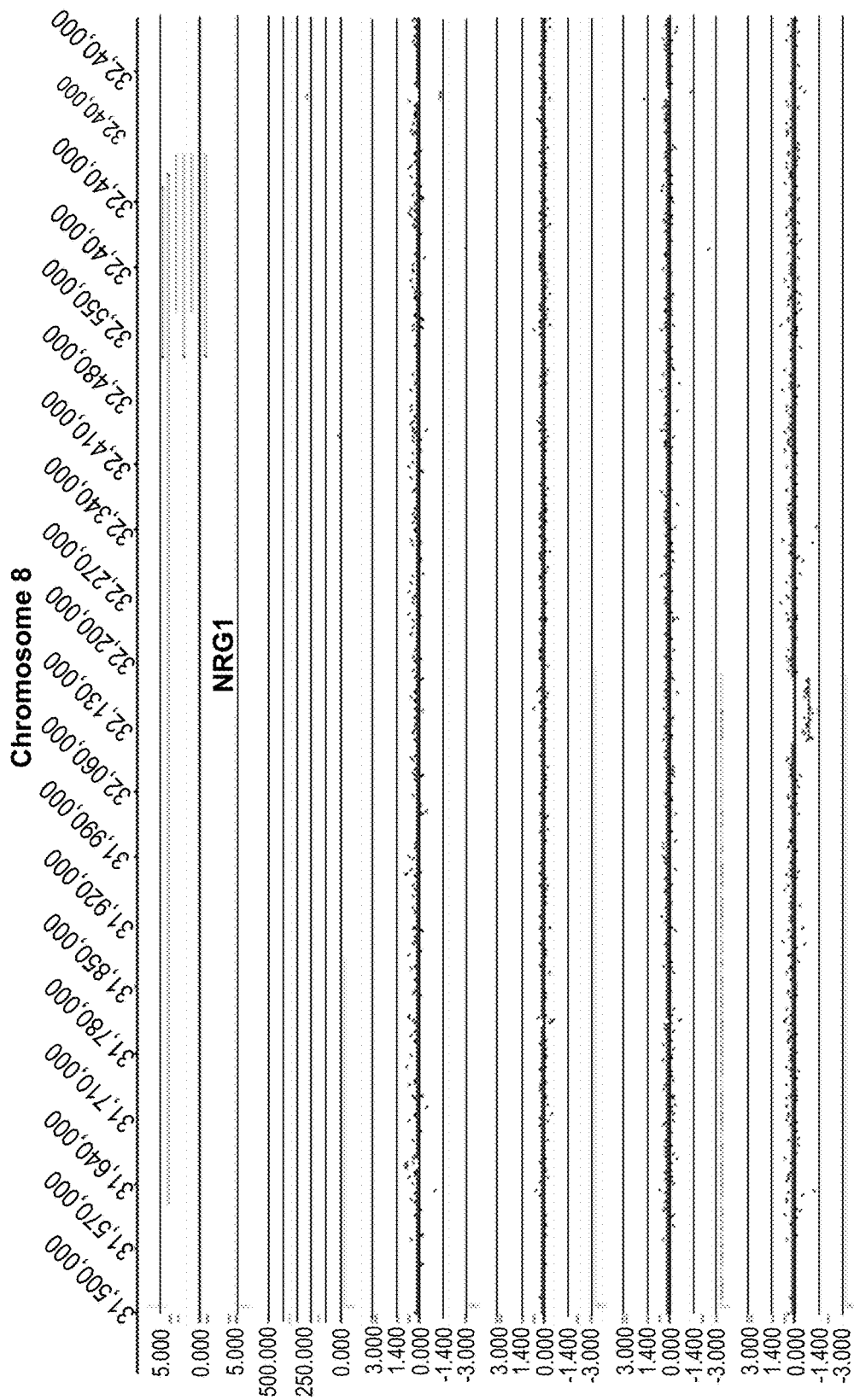
FIG. 1 represents an example of group 1 (Genic (distinct CNV-subregions); OR>6). There are 10 ASD cases and 0 NVE subjects affected by non-overlapping and overlapping CNV-subregions. The CNV are gains (log 2 ratio>0.35) or losses (log 2 ratio<−0.35) and affect the gene NRG1 on chromosome 8. The calculated odds ratio (OR) for this CNV-subregion is 14.94.
Figure 1:
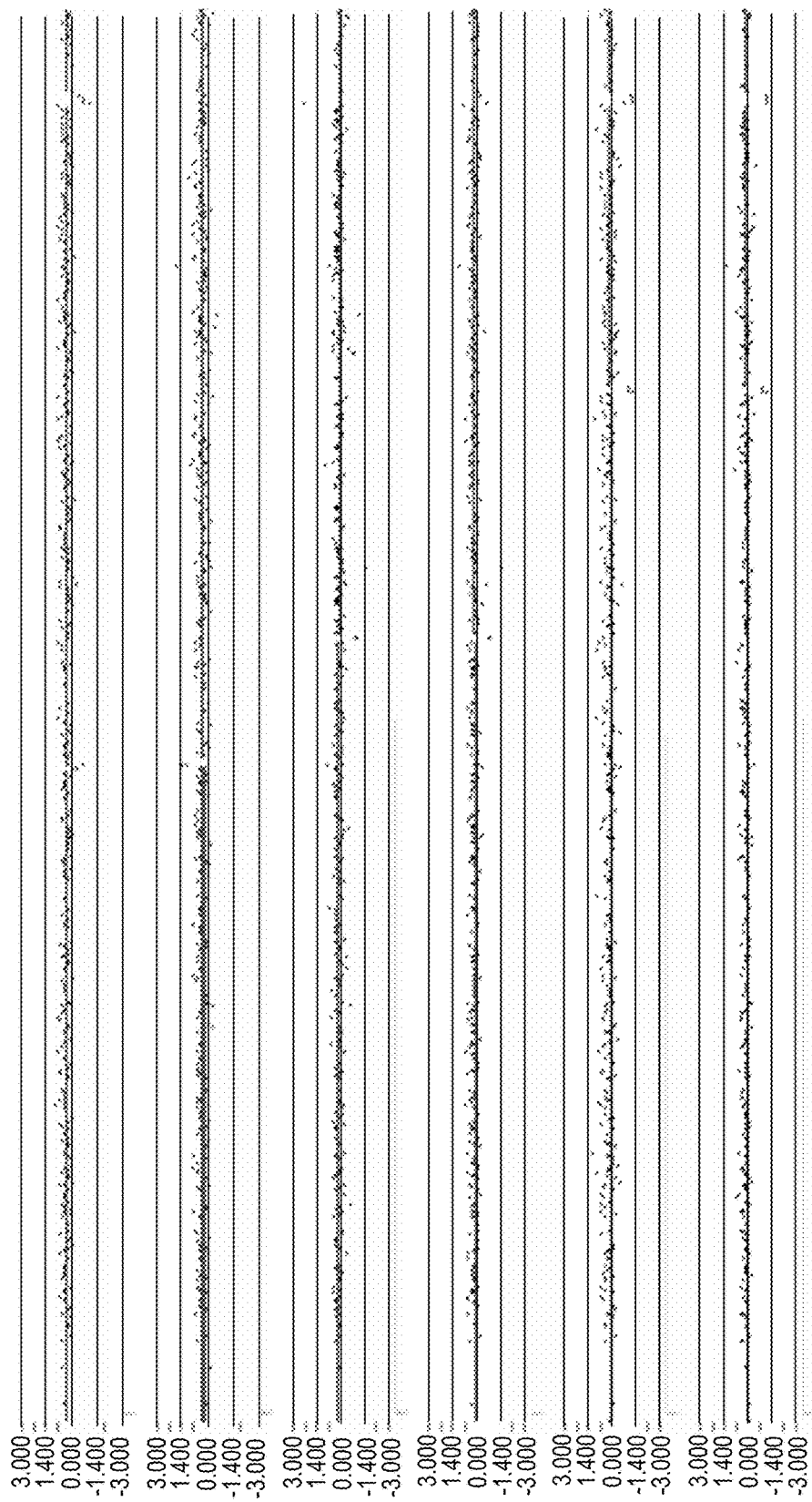

In one aspect, provided herein is a method of screening one or more subjects for at least one genetic variation that disrupts or modulates one or more genes in Table 3, comprising: assaying at least one nucleic acid sample obtained from each of the one or more subjects for the at least one genetic variation in one or more genes in Table 3. In some embodiements, the at least one genetic variation is associated with a developmental disorder (DD). In some embodiments, the at least one genetic variation is one encoded by one or more of SEQ ID NOs 1 to 883. In some embodiments, the at least one genetic variation comprises one or more point mutations, single nucleotide polymorphisms (SNPs), single nucleotide variants (SNVs), translocations, insertions, deletions, amplifications, inversions, microsatellites, interstitial deletions, copy number variations (CNVs), or any combination thereof. In some embodiments, the at least one genetic variation disrupts or modulates one or more genes in Table 3. In some embodiments, the at least one genetic variation disrupts or modulates two or more genes in Table 3. In some embodiments, the at least one genetic variation disrupts or modulates the expression or function of one or more RNA transcripts encoded by SEQ ID NOs 884-1690, one or more polypeptides produced therefrom, or a combination thereof. In some embodiments, the assaying comprises detecting nucleic acid information from the at least one nucleic acid sample. In some embodiments, the nucleic acid information is detected by one or more methods selected from the group comprising PCR, sequencing, Northern blots, or any combination thereof. In some embodiments, the sequencing comprises one or more high-throughput sequencing methods. In some embodiments, the one or more high throughput sequencing methods comprise Massively Parallel Signature Sequencing (MPSS), polony sequencing, 454 pyrosequencing, Illumina sequencing, SOLiD sequencing, ion semiconductor sequencing, DNA nanoball sequencing, heliscope single molecule sequencing, single molecule real time (SMRT) sequencing, RNAP sequencing, Nanopore DNA sequencing, sequencing by hybridization, or microfluidic Sanger sequencing. In some embodiments, the at least one nucleic acid sample is collected from blood, saliva, urine, serum, tears, skin, tissue, or hair from the one or more subjects. In some embodiments, the assaying the at least one nucleic acid sample of the one or more subjects comprises purifying nucleic acids from the at least one nucleic acid sample. In some embodiments, the assaying the at least one nucleic acid sample of the one or more subjects comprises amplifying at least one nucleotide sequence in the at least one nucleic acid sample. In some embodiments, the assaying the at least one nucleic acid sample for at least one genetic variation comprises a microarray analysis of the at least one nucleic acid sample. In some embodiments, the microarray analysis comprises a CGH array analysis. In some embodiments, the CGH array detects the presence or absence of the at least one genetic variations. In some embodiments, the method further comprises determining whether the one or more subjects has a DD, or an altered susceptibility to a DD. In some embodiments, the one or more subjects were previously diagnosed or are suspected as having the DD. In some embodiments, the diagnosis or grounds for suspicion that the subject may have the DD is based on an evaluation by a medical doctor, a psychologist, a neurologist, a psychiatrist, or other professionals who screen subjects for the DD. In some embodiments, the determining comprises an evaluation of the one or more subject's motor skills, autonomic function, neurophychiatry, mood, cognition, behavior, thoughts, speech, or a combination thereof. In some embodiments, the evaluation comprises observation, a questionnaire, a checklist, a test, or a combination thereof. In some embodiments, the evaluation comprises a developmental exam, the subject's past medical histroy, or a combination thereof. In some embodiments, the screening the one or more subjects further comprises selecting one or more therapies based on the presence or absence of the one or more genetic variations. In some embodiments, the assaying at least one nucleic acid sample obtained from each of the one or more subjects comprises analyzing the whole genome or whole exome from the one or more subjects. In some embodiments, the nucleic acid information has already been obtained for the whole genome or whole exome from the one or more individuals and the nucleic acid information is obtained from in silico analysis. In some embodiments, the DD is Autism Spectrum Disorder (ASD). In some embodiments, the one or more subjects have at least one symptom of a DD. In some embodiments, the at least one symptom comprises difficulty with verbal communication, including problems using and understanding language, difficulty with non-verbal communication, such as gestures and facial expressions such as smiling, difficulty with social interaction, including relating to people and to his or her surroundings, unusual ways of playing with toys and other objects, difficulty adjusting to changes in routine or familiar surroundings, repetitive body movements or patterns of behavior, such as hand flapping, spinning, and head banging, changing response to sound, temper tantrums, difficulty sleeping, aggressive behavior, fearfulness, anxiety, or a combination thereof. In some embodiments, the one or more subjects are human. In some embodiments, the one or more subjects are less than 30 years old, less than 20 years old, less than 10 years old, less than 5 years old, less than 2 years old, or less than 1 year old.

In one aspect, provided herein is a method of diagnosing one or more first subjects for a DD, comprising: assaying at least one nucleic acid sample of each of the one or more subjects for the presence or absence of at least one genetic variation in one or more genes in Table 3. In some embodiments, the at least one genetic variation is one encoded by at least one of SEQ ID NOs 1-883. In some embodiments, the one or more first subjects is diagnosed with the DD if the at least one genetic variation is present. In some embodiments, the one or more first subjects is not diagnosed with DD if the at least one genetic variation is absent. In some embodiments, the assaying comprises detecting nucleic acid information from the at least one nucleic acid sample. In some embodiments, the nucleic acid information is detected by one or more methods selected from the group comprising PCR, sequencing, Northern blots, hybridization, or any combination thereof. In some embodiments, the sequencing comprises one or more high-throughput sequencing methods. In some embodiments, the one or more high throughput sequencing methods comprise Massively Parallel Signature Sequencing (MPSS), polony sequencing, 454 pyrosequencing, Illumina sequencing, SOLiD sequencing, ion semiconductor sequencing, DNA nanoball sequencing, heliscope single molecule sequencing, single molecule real time (SMRT) sequencing, RNAP sequencing, Nanopore DNA sequencing, sequencing by hybridization, or microfluidic Sanger sequencing. In some embodiments, the method further comprises determining whether the one or more first subjects has a DD or an altered susceptibility to a DD. In some embodiments, the one or more first subjects were previously diagnosed or are suspected as having the DD based on an evaluation by a medical doctor, a psychologist, a neurologist, a psychiatrist, a speech therapist, or other professionals who screen subjects for a DD. In some embodiments, the determining comprises an evaluation of the one or more first subject's motor skills, autonomic function, neurophychiatry, mood, cognition, behavior, thoughts, speech, or a combination thereof. In some embodiments, the evaluation comprises observation, a questionnaire, a checklist, a test, or a combination thereof. In some embodiments, the evaluation comprises a developmental exam, the subject's past medical histroy, or a combination thereof. In some embodiments, the determining comprises comparing the nucleic acid information of the one or more first subjects to nucleic acid information of one or more second subjects. In some embodiments, the one more second subjects comprise one or more subjects not suspected of having the DD. In some embodiments, the one or more second subjects comprise one or more subjects suspected of having the DD. In some embodiments, the one or more first subjects comprise one or more subjects with the DD. In some embodiments, the one or more second subjects comprise one or more subjects without the DD. In some embodiments, the one or more first subjects comprise one or more subjects who are symptomatic for the DD. In some embodiments, the one or more second subjects comprise one or more subjects who are asymptomatic for the DD. In some embodiments, the one or more first subjects comprise one or more subjects that have an increased susceptibility to the DD. In some embodiments, the one or more second subjects comprise one or more subjects that have a decreased susceptibility to the DD. In some embodiments, the one or more first subjects comprise one or more subjects receiving a treatment, therapeutic regimen, or any combination thereof for a DD. In some embodiments, determining whether the one or more subjects have the DD or an altered susceptibility to the DD comprises analyzing at least one behavioral analysis of the one or more subjects and the nucleic acid sequence information of the one or more subjects, or a combination thereof. In some embodiments, the at least one nucleic acid sample is collected from blood, saliva, urine, serum, tears, skin, tissue, or hair from the one or more subjects. In some embodiments, assaying comprises purifying nucleic acids from the at least one nucleic acid sample. In some embodiments, assaying comprises amplifying at least one nucleotide sequence in the at least one nucleic acid sample. In some embodiments, assaying comprises a microarray analysis of the at least one nucleic acid sample. In some embodiments, wherein the microarray analysis comprises a CGH array analysis. In some embodiments, the CGH array detects the presence or absence of the at least one genetic variations. In some embodiments, the at least one genetic variation comprises one or more point mutations, single nucleotide polymorphisms, (SNPs), single nucleotide variants (SNVs), translocations, insertions, deletions, amplifications, inversions, microsatellites, interstitial deletions, copy number variations (CNVs), or any combination thereof. In some embodiments, the at least one genetic variation results in a loss of function for one or more genes in Table 3, a gain of function for one or more genes in Table 3, or a combination thereof. In some embodiments, the at least one genetic variation disrupts or modulates the one or more genes in Table 3. In some embodiments, the at least one genetic variation disrupts or modulates the expression or function of one or more RNA transcripts encoded by SEQ ID NOs 884-1690. In some embodiments, the method further comprises selecting one or more therapies based on the presence or absence of the one or more genetic variations. In some embodiments, the assaying at least one nucleic acid sample obtained from each of the one or more subjects comprises analyzing the whole genome or whole exome from the one or more subjects. In some embodiments, the nucleic acid information has already been obtained for the whole genome or whole exome from the one or more individuals and the nucleic acid information is obtained from in silico analysis. In some embodiments, the DD is ASD. In some embodiments, the one or more subjects has at least one symptom of a DD. In some embodiments, the at least one symptom comprises difficulty with verbal communication, including problems using and understanding language, difficulty with non-verbal communication, such as gestures and facial expressions such as smiling, difficulty with social interaction, including relating to people and to his or her surroundings, unusual ways of playing with toys and other objects, difficulty adjusting to changes in routine or familiar surroundings, repetitive body movements or patterns of behavior, such as hand flapping, spinning, and head banging, changing response to sound, temper tantrums, difficulty sleeping, aggressive behavior, fearfulness, anxiety, or a combination thereof. In some embodiments, the one or more subjects are human. In some embodiments, the one or more subjects is less than 30 years old, less than 20 years old, less than 10 years old, less than 5 years old, less than 2 years old, or less than 1 year old.

In one aspect, provided herein is a method of screening for a therapeutic agent for treatment of a DD, comprising identifying an agent that disrupts or modulates one or more genes in Table 3, or one or more expression products thereof. In some embodiments, the one or more expression products comprise one or more RNA transcripts. In some embodiments, the one or more RNA transcripts comprise one or more RNA transcripts of Table 4, or one ore more RNA transcripts encoded by any of SEQ ID NOs 884-1690. In some embodiments, the one or more expression products comprise one or more polypeptides. In some embodiments, the one or more polypeptides are translated from one or more RNA transcripts of Table 4, or one ore more RNA transcripts encoded by any of SEQ ID NOs 884-1690. In some embodiments, disrupting or modulating the one or more genes in Table 3 or one or more expression products thereof, comprises an increase in expression of the one or more expression products. In some embodiments, disrupting or modulating the one or more genes in Table 3 or one or more expression products thereof, comprises a decrease in expression of the one or more expression products.

In one aspect, provided herein is a method of treating a subject for a DD, comprising administering one or more agents to disrupt or modulate one or more genes in Table 3 or one or more expression products thereof, thereby treating the DD. In some embodiments, the one or more expression products comprise one or more RNA transcripts. In some embodiments, the one or more RNA transcripts comprise one or more RNA transcripts of Table 4, or one ore more RNA transcripts encoded by any of SEQ ID NOs 884-1690. In some embodiments, the one or more expression products comprise one or more polypeptides. In some embodiments, the one or more polypeptides are translated from one or more RNA transcripts of Table 4, or one ore more RNA transcripts encoded by any of SEQ ID NOs 884-1690. In some embodiments, the one or more agents are selected from the group comprising: an antibody, a drug, a combination of drugs, a compound, a combination of compounds, radiation, a genetic sequence, a combination of genetic sequences, heat, cryogenics, and a combination of two or more of any combination thereof. In some embodiments, the DD is ASD. In some embodiments, the one or more subjects has at least one symptom of a DD. In some embodiments, the at least one symptom comprises difficulty with verbal communication, including problems using and understanding language, difficulty with non-verbal communication, such as gestures and facial expressions such as smiling, difficulty with social interaction, including relating to people and to his or her surroundings, unusual ways of playing with toys and other objects, difficulty adjusting to changes in routine or familiar surroundings, repetitive body movements or patterns of behavior, such as hand flapping, spinning, and head banging, changing response to sound, temper tantrums, difficulty sleeping, aggressive behavior, fearfulness, anxiety, or a combination thereof. In some embodiments, the one or more subjects is human. In some embodiments, the one or more subjects is less than 30 years old, less than 20 years old, less than 10 years old, less than 5 years old, less than 2 years old, or less than 1 year old.

In one aspect, provided herein is a kit for screening for a DD in one or more subjects, the kit comprising reagents for assaying a nucleic acid sample from the one or more subjects for the presence of at least one genetic variation encoded by SEQ ID NOs 1-883. In some embodiments, the at least one genetic variation disrupts or modulates one or more genes in Table 3, or one or more expression products thereof. In some embodiments, the one or more expression products comprise one or more RNA transcripts. In some embodiments, the one or more RNA transcripts comprise one or more RNA transcripts of Table 4, or one ore more RNA transcripts encoded by any of SEQ ID NOs 884-1690. In some embodiments, the one or more expression products comprise one or more polypeptides. In some embodiments, the one or more polypeptides are translated from one or more RNA transcripts of Table 4, or one ore more RNA transcripts encoded by any of SEQ ID NOs 884-1690. In some embodiments, the reagents comprise nucleic acid probes. In some embodiments, the reagents comprise oligonucleotides. In some embodiments, the reagents comprise primers. In some embodiments, the DD is ASD. In some embodiments, the one or more subjects has a symptom of a DD. In some embodiments, the one or more subjects is human. In some embodiments, the one or more subjects is less than 30 years old, less than 20 years old, less than 10 years old, less than 5 years old, less than 2 years old, or less than 1 year old.

In one aspect, provided herein is an isolated polynucleotide sequence or fragment thereof, comprising at least 60% identity to any of polynucleotide sequence of SEQ ID NOs 1-1690. In one aspect, provided herein is an isolated polynucleotide comprising a CNV sequence encoded by any one of SEQ ID NOs 1-883. In some embodiments, the isolated polynucleotide sequence comprises at least 70% identity to any of polynucleotide sequence of SEQ ID NOs 1-1690. In some embodiments, the isolated polynucleotide sequence comprises at least 80% identity to any of polynucleotide sequence of SEQ ID NOs 1-1690. In some embodiments, the isolated polynucleotide sequence comprises at least 90% identity to any of polynucleotide sequence of SEQ ID NOs 1-1690.

In one aspect, provided herein is an isolated polynucleotide sequence comprising at least 60% identity to a compliment of any of polynucleotide sequence of SEQ ID NOs 1-1690. In some embodiments, the isolated polynucleotide sequence comprises at least 70% identity to a compliment of any of polynucleotide sequence of SEQ ID NOs 1-1690. In some embodiments, the isolated polynucleotide sequence comprises at least 80% identity to a compliment of any of polynucleotide sequence of SEQ ID NOs 1-1690. In some embodiments, the isolated polynucleotide sequence comprises at least 90% identity to a compliment of any of polynucleotide sequence of SEQ ID NOs 1-1690. In some embodiments, the polynucleotide sequence comprises any of a CNV of SEQ ID NOs 1-883. In some embodiments, the polynucleotide sequence comprises any of a genomic sequence of a gene in Table 3. In some embodiments, the sequence comprises an RNA sequence transcribed from a genomic sequence of a gene in Table 3. In some embodiments, the polynucleotide sequence comprises any of genetic variation not present in the genome of a subject without a DD. In some embodiments, the polynucleotide sequence fragment comprises a nucleic acid probe. In some embodiments, the nucleic acid probe is capable of hybridization to a nucleic acid of interest. In some embodiments, the polynucleotide sequence fragment comprises a nucleic acid primer. In some embodiments, the nucleic acid primer is capable of intiation of extension or amplifying of a nucleic acid of interest.

In one aspect, provided herein is an isolated polypeptide encoded by an RNA sequence transcribed from any of genomic sequence of a gene in Table 3.

In one aspect, provided herein is a host cell comprising an expression control sequence operably linked to a polynucleotide selected from the group consisting of any of polynucleotide sequence of a gene in Table 3, or a genetic variant encoded by any one of SEQ ID NOs 1-883. In some embodiments, the expression control sequence is non-native to the host cell. In some embodiments, the expression control sequence is native to the host cell.

In one aspect, provided herein is a method for identifying an agent having a therapeutic benefit for treatment of a DD, comprising: (a) providing cells comprising at least one genetic variation of SEQ ID NOs 1-883, (b) contacting the cells of (a) with a test agent, and (c) analyzing whether the agent has a therapeutic benefit for treatment of the cells of (a), thereby identifying agents which have a therapeutic benefit for treatment of the DD.

In some embodiments, the method further comprises (d) providing cells which do not comprise at least one genetic variation of SEQ ID NOs 1-883, (e) contacting the cells of (a) and (d) with a test agent, and (f) analyzing whether the agent has a therapeutic benefit for treatment of the cells of (a) relative to those of (d), thereby identifying agents which have a therapeutic benefit for treatment of the DD. In some embodiments, the therapeutic agent has efficacy for the treatment of a DD. In some embodiments a therapeutic agent is identified by the method results.

In one aspect, provided herein is a panel of biomarkers for a DD comprising one or more genes contained in one or more polynucleotide sequences of a gene in Table 3. In some embodiments, the panel comprises two or more genes contained in the one or more polynucleotide sequences selected from the genes in Table 3. In some embodiments, the panel comprises at least 5, 10, 25, 50, 100 or 200 polynucleotide sequences of the genes in Table 3. In some embodiments, at least one of the polynucleotide sequences is a fragment of the one or more polynucleotide sequences selected from the genes in Table 3. In some embodiments, at least one of the polynucleotide sequences is a variant of the one or more polynucleotide sequences selected from the genes in Table 3. In some embodiments, the panel is selected for analysis of polynucleotide expression levels for a DD. In some embodiments, the polynucleotide expression levels are mRNA expression levels. In some embodiments, the panel is used in the management of patient care for a DD, wherein the management includes one or more of risk assessment, early diagnosis, prognosis establishment, patient treatment monitoring, and treatment efficacy detection. In some embodiments, the panel is used in discovery of therapeutic intervention of a DD. In some embodiments, at least one of the biomarkers is attached to substrate. In some embodiments, the substrate comprises a plastic, glass, a bead, or a plate. In some embodiments, at least one of the biomarkers is labeled with a detectable label. In some embodiments, the panel is an in silico panel.

In one aspect, provided herein is a method for measuring expression levels of polynucleotide sequences from biomarkers for a DD in a subject, comprising: (a) selecting a panel of biomarkers comprising two or more genes contained in one or more polynucleotide sequences selected from the genes in Table 3; (b) isolating cellular RNA from a nucleic acid sample obtained from the subject; (c) synthesizing cDNA from the RNA for each biomarker in the panel using suitable primers; (d) optionally amplifying the cDNA; and (e) quantifying levels of the cDNA from the nucleic acid sample. In some embodiments, the step of selecting a panel of biomarkers comprises at least 5, 10, 25, 50, 100 or 200 genes contained in one or more polynucleotide sequences selected from the genes in Table 3. In some embodiments, the step of quantifying the levels of cDNA further comprises labeling cDNA. In some embodiments, labeling cDNA comprises labeling with at least one chromophore. In some embodiments, the cDNA levels for the nucleic acid sample are compared to a control cDNA level. In some embodiments, the comparison is used in the management of patient care in DD. In some embodiments, the management of patient care includes one or more of risk assessment, early diagnosis, establishing prognosis, monitoring patient treatment, and detecting treatment efficacy. In some embodiments, the comparison is used in discovery of therapeutic intervention of a DD.

In one aspect, provided herein is a method for measuring expression levels of polypeptides comprising: (a) selecting a panel of biomarkers comprising at least two polypeptides encoded by an RNA sequence transcribed from a genomic sequence of a gene in Table 3; (b) obtaining a nucleic acid sample; (c) creating an antibody panel for each biomarker in the panel; (d) using the antibody panel to bind the polypeptides from the nucleic acid sample; and (e) quantifying levels of the polypeptides bound from the nucleic acid sample to the antibody panel. In some embodiments, the polypeptide levels of the nucleic acid sample are increased or decreased compared to the polypeptide levels of a control nucleic acid sample. In some embodiments, the subject is treated for a DD patient based on the quantified levels of the polypeptides bound from the nucleic acid sample to the antibody panel. In some embodiments, the treatment of a subject includes one or more of risk assessment, early diagnosis, establishing prognosis, monitoring patient treatment, and detecting treatment efficacy. In some embodiments, the comparison is used in discovery of a therapeutic intervention of a DD.

In one aspect, provided herein is a kit for the determination of a DD comprising: at least one reagent that is used in analysis of one or more polynucleotide expression levels for a panel of biomarkers for a DD, wherein the panel comprises two or more genes contained in one or more polynucleotide sequences selected from the genes in Table 3, and instructions for using the kit for analyzing the expression levels. In some embodiments, the one or more polynucleotide expression levels comprise one or more RNA transcript expression levels. In some embodiments, the one or more RNA transcript expression levels correspond to one or more RNA transcripts of Table 4, or one ore more RNA transcripts encoded by any of SEQ ID NOs 884-1690. In some embodiments, the at least one reagent comprises at least two sets of suitable primers. In some embodiments, the at least one reagent comprises a reagent for the preparation of cDNA. In some embodiments, the at least one reagent comprises a reagent that is used for detection and quantization of polynucleotides. In some embodiments, the at least one reagent comprises one or more antibodies wherein the one or more antibodies detect the one or more polypeptides are translated from one or more RNA transcripts of Table 4, or the one ore more RNA transcripts encoded by any of SEQ ID NOs 884-1690. In some embodiments, the at least one reagent comprises at least one chromophore.

In one aspect, provided herein is a kit for the determination of a DD comprising: at least one reagent that is used in analysis of polypeptide expression levels for a panel of biomarkers for DD, wherein the panel comprises at least two polypeptides expressed from two or more genes contained in one or more polynucleotide sequences selected from the genes in Table 3; and instructions for using the kit for analyzing the expression levels. In some embodiments, the reagent is an antibody reagent that binds a polypeptide selected in the panel. In some embodiments, the kit further comprises a reagent that is used for detection of a bound polypeptide. In some embodiments, the reagent includes a second antibody.

In one aspect, provided herein is a method of screening a subject for a DD, the method comprising: (a) assaying a nucleic acid sample obtained from the subject by PCR, aCGH, sequencing, SNP genotyping, or Fluorescence in Situ Hybridization to detect sequence information for more than one genetic loci; (b) comparing the sequence information to a panel of nucleic acid biomarkers, wherein the panel comprises at least one nucleic acid biomarker for each of the more than one genetic loci; and wherein the panel comprises at least 2 low frequency nucleic acid biomarkers, wherein the low frequency nucleic acid biomarkers occur at a frequency of 0.1% or less in a population of subjects without a diagnosis of the DD; and (c) screening the subject for the presence or absence of the DD if one or more of the low frequency biomarkers in the panel are present in the sequence information. In some embodiments, the panel comprises at least 5, 10, 25, 50, 100 or 200 low frequency nucleic acid biomarkers. In some embodiments, the presence or absence of the DD in the subject is determined with more than 50%, 55%, 65%, 70%, 75%, 80%, 85%, 90%, 95%, 97%, 98%, 99%, 99.5%, or 99.8% confidence. In some embodiments, the low frequency biomarkers occur at a frequency of 0.01% or less, 0.001% or less, or 0.0001% or less in a population of subjects without a diagnosis of the DD. In some embodiments, the panel of nucleic acid biomarkers comprises at least two genes contained in the one or more polynucleotide sequences selected from the genes in Table 3. In some embodiments, the DD is ASD. In some embodiments, the method further comprises identifying a therapeutic agent useful for treating the DD. In some embodiments, the method further comprises administering one or more of the therapeutic agents to the subject if one or more of the low frequency biomarkers in the panel are present in the sequence information.

In one aspect, provided herein is a kit for screening a subject for a DD, the kit comprising at least one reagent for assaying a nucleic acid sample from the subject for information on a panel of nucleic acid biomarkers, wherein the panel comprises at least 2 low frequency biomarkers, and wherein the low frequency biomarkers occur at a frequency of 0.1% or less in a population of subjects without a diagnosis of the DD. In some embodiments, a presence or absence of the DD in the subject is determined with more than 50%, 55%, 65%, 70%, 75%, 80%, 85%, 90%, 95%, 97%, 98%, 99%, 99.5%, or 99.8% confidence. In some embodiments, the panel comprises at least 5, 10, 25, 50, 100 or 200 low frequency nucleic acid biomarkers. In some embodiments, the low frequency biomarkers occur at a frequency of 0.01% or less, 0.001% or less, or 0.0001% or less in a population of subjects without a diagnosis of the DD. In some embodiments, the panel of nucleic acid biomarkers comprises at least two genes contained in the one or more polynucleotide sequences selected from the genes in Table 3. In some embodiments, the at least one reagent comprises at least two sets of suitable primers. In some embodiments, the at least one reagent comprises a reagent for the preparation of cDNA. In some embodiments, the at least one reagent comprises a reagent that is used for detection and quantization of polynucleotides. In some embodiments, the at least one reagent comprises at least one chromophore.

In one aspect, provided herein is a method of generating a panel of nucleic acid biomarkers comprising: (a) assaying a nucleic acid sample from a first population of subjects by PCR, aCGH, sequencing, SNP genotyping, or Fluorescence in Situ Hybridization for nucleic acid sequence information, wherein the subjects of the first population have a diagnosis of a DD. (b) assaying a nucleic acid sample from a second population of subjects by PCR, aCGH, sequencing, SNP genotyping, or Fluorescence in Situ Hybridization for nucleic acid sequence information, wherein the subjects of the second population are without a diagnosis of a DD; (c) comparing the nucleic acid sequence information from step (a) to that of step (b); (d) determining the frequency of one or more biomarkers from the comparing step; and (e) generating the panel of a nucleic acid biomarkers, wherein the panel comprises at least 2 low frequency biomarkers, and wherein the low frequency biomarkers occur at a frequency of 0.1% or less in a population of subjects without a diagnosis of a DD. In some embodiments, the subjects in the second population of subjects without a diagnosis of a DD comprise one or more subjects not suspected of having the DD. In some embodiments, the subjects in the second population of subjects without a diagnosis of a DD comprise one or more subjects without the DD. In some embodiments, the subjects in the second population of subjects without a diagnosis of a DD comprise one or more subjects who are asymptomatic for the DD. In some embodiments, the subjects in the second population of subjects without a diagnosis of a DD comprise one or more subjects who have decreased susceptibility to the DD. In some embodiments, the subjects in the second population of subjects without a diagnosis of a DD comprise one or more subjects who are unassociated with a treatment, therapeutic regimen, or any combination thereof. In some embodiments, the panel comprises at least 5, 10, 25, 50, 100 or 200 low frequency nucleic acid biomarkers. In some embodiments, the low frequency biomarkers occur at a frequency of 0.01% or less, 0.001% or less, or 0.0001% or less in the second population of subjects without a diagnosis of a DD In some embodiments, the panel comprises at least two genes contained in the one or more polynucleotide sequences selected from the genes in Table 3. In some embodiments, the DD is ASD. In some embodiments, assaying the at least one nucleic acid sample of the one or more subjects comprises purifying the at least one nucleic acid sample from the collected sample. In some embodiments, the method further comprises designing the CGH array to measure one or more genetic variations in Table 1, Table 2, or combinations thereof. In some embodiments, the method further comprises providing the CGH array for the measuring of one or more genetic variations. In some embodiments, assaying at least one nucleic acid sample comprises obtaining the nucleic acid sequence information. In some embodiments, obtaining the nucleic acid information is determined by one or more methods selected from the group comprising PCR, sequencing, Northern blots, FISH, Invader assay, or any combination thereof. In some embodiments, the at least one genetic variation comprises one or more point mutations, polymorphisms, single nucleotide polymorphisms (SNPs), single nucleotide variants (SNVs), translocations, insertions, deletions, amplifications, inversions, microsatellites, interstitial deletions, copy number variations (CNVs), loss of heterozygosity, or any combination thereof. In some embodiments, the at least one genetic variation comprises one or more CNVs listed in Table 1 or CNV subregions in Table 2. In some embodiments, the genetic variation comprises one or more CNVs that disrupt, impair, or modulate expression of one or more genes listed in Table 3. In some embodiments, the at least one genetic variation comprises one or more CNVs that disrupt, impair, or modulate the expression or function of one or more RNA transcripts in Table 4, or one ore more RNA transcripts encoded by any of SEQ ID NOs 884-1690.

In one aspect, provided herein is a method for screening for a therapeutic agent useful for treating a DD, comprising identifying an agent that modulates the function or expression of one or more genes listed in Table 3 or expression products therefrom. In some embodiments, the expression products comprise one or more RNA transcripts in Table 4, or one ore more RNA transcripts encoded by any of SEQ ID NOs 884-1690. In some embodiments, the expression products comprise one or more proteins expressed from a gene in Table 3 or encoded by one or more RNA transcripts in Table 4, or by any of SEQ ID NOs 884-1690. In some embodiments, modulating the function or activity of one or more RNA transcripts or proteins comprises an increase in expression. In some embodiments, modulating the function or activity of one or more RNA transcripts or proteins comprises a decrease in expression.

In one aspect, provided herein is a method of treating a subject for a DD, comprising administering one or more agents to modulate the function of one or more genes listed in Table 3, or expression products therefrom, thereby treating the DD. In some embodiments, the expression products comprise one or more RNA transcripts in Table 4, or one ore more RNA transcripts encoded by any of SEQ ID NOs 884-1690. In some embodiments, the expression products comprise one or more proteins expressed from a gene in Table 3, or encoded by one or more RNA transcripts in Table 4. In some embodiments, the one or more agents are selected from the group comprising: an antibody, a drug, a combination of drugs, a compound, a combination of compounds, radiation, a genetic sequence, a combination of genetic sequences, heat, cryogenics, and a combination of two or more of any combination thereof.

In one aspect, provided herein is a kit for screening for a DD in a subject, the kit comprising at least one means for assaying a nucleic acid sample from the subject for the presence of at least one genetic variation in Table 1 or 2 associated with a DD. In some embodiments, the at least one genetic variation is associated with a disruption or aberration of one or more RNA transcripts in Table 4 or one ore more RNA transcripts encoded by any of SEQ ID NOs 884-1690. In some embodiments, the at least one genetic variation is associated with a disruption or aberration of one or more proteins expressed from one or more genes listed in Tables 3, or encoded by one or more RNA transcripts in Table 4 or one ore more RNA transcripts encoded by any of SEQ ID NOs 884-1690. In some embodiments, screening the one or more subjects further comprises selecting one or more therapies based on the presence or absence of the one or more genetic variations.

In one aspect, provided herein is a method comprising isolating a poluynucleotide comprising a CNV sequence encoded by any one of SEQ ID NOs 1-883. In some embodiments, assaying the at least one nucleic acid sample of the one or more subjects comprises an analysis of the at least one collected sample or unamplified nucleic acid sample. In some embodiments, assaying the at least one nucleic acid sample of the one or more subjects comprises an Invader assay analysis of the at least one collected sample or unamplified nucleic acid sample. In some embodiments, the method further comprises assaying one or more other genetic variations in the one or more genes in Table 3, wherein the other genetic variations do not comprise a genetic variation encoded by any one of SEQ ID NOs. 1-883. In some embodiments, the one or more other genetic variations are shorter in length than one or more of the genetic variations encoded by any one of SEQ ID NOs. 1-883. In some embodiments, the sequence information of one or more other genetic variations are compared to a compilation of data comprising frequencies of the other genetic variations in at least 2 normal human subjects. In some embodiments, the method further comprises determining whether the other genetic variations are associated with a DD by the comparison. In some embodiments, the assaying comprises analyzing the whole genome or whole exome from the one or more subjects. In some embodiments, the comparing comprises determining an odds ratio (OR) value for the one or more other genetic variations, determining a relative risk value (RR) for the one or more other genetic variations, or a combination thereof. In some embodiments, determining whether the one or more subjects has a DD or an altered susceptibility to a DD comprises comparing the nucleic acid sequence information, the at least one genetic variation identified in the one or more subjects, or a combination thereof, to those of one or more other subjects for enrollment of said subjects or said other subjects in a clinical trial. In some embodiments, the method further comprises detecting one or more genetic variants in an upstream or downstream region of the one or more genes in Table 3 that results in modulation of expression of the gene. In some embodiments, the upstream or downstream region is a gene regulatory sequence. In some embodiments, the method further comprises obtaining sequence information for one or more of the CNVs encoded by SEQ ID NOs 1-883. In some embodiments, the nucleic acid information further comprises sequence information for one or more of the CNVs encoded by SEQ ID NOs 1-883. In some embodiments, sequence information for one or more of the CNVs encoded by SEQ ID NOs 1-883 comprises nucleic acid information relating to a regulatory region of a gene in Table 3.

DETAILED DESCRIPTION OF THE DISCLOSURE

The details of one or more inventive embodiments are set forth in the accompanying drawings, the claims, and in the description herein. Other features, objects, and advantages of inventive embodiments disclosed and contemplated herein will be apparent from the description and drawings, and from the claims. As used herein, unless otherwise indicated, the article "a" means one or more unless explicitly otherwise provided for. As used herein, unless otherwise indicated, terms such as "contain," "containing," "include," "including," and the like mean "comprising." As used herein, unless otherwise indicated, the term "or" can be conjunctive or disjunctive. As used herein, unless otherwise indicated, any embodiment can be combined with any other embodiment. As used herein, unless otherwise indicated, some inventive embodiments herein contemplate numerical ranges. When ranges are present, the ranges include the range endpoints. Additionally, every subrange and value within the range is present as if explicitly written out.

Described herein are methods of identifying variations in nucleic acids and genes associated with one or more developmental conditions. Described herein are methods of screening for determining a subject's susceptibility to developing or having, one or more developmental disorders, for example Autism Spectrum Disorder (ASD), based on identification and detection of genetic nucleic acid variations. Also described herein, are methods and compositions for treating and/or preventing one or more developmental conditions using a therapeutic modality. The present disclosure encompasses methods of assessing an individual for probability of response to a therapeutic agent for a developmental disorder, methods for predicting the effectiveness of a therapeutic agent for a developmental disorder, nucleic acids, polypeptides and antibodies and computer-implemented functions. Kits for screening a sample from a subject to detect or determine susceptibility to a developmental disorder are also encompassed by the disclosure.

Genetic Variations Associated with Developmental Disorders

Genomic sequences within populations exhibit variability between individuals at many locations in the genome. For example, the human genome exhibits sequence variations that occur on average every 500 base pairs. Such genetic variations in nucleic acid sequences are commonly referred to as polymorphisms or polymorphic sites. As used herein, a polymorphism, e.g. genetic variation, includes a variation in the sequence of a gene in the genome amongst a population, such as allelic variations and other variations that arise or are observed. Thus, a polymorphism refers to the occurrence of two or more genetically determined alternative sequences or alleles in a population. These differences can occur in coding and non-coding portions of the genome, and can be manifested or detected as differences in nucleic acid sequences, gene expression, including, for example transcription, processing, translation, transport, protein processing, trafficking, DNA synthesis; expressed proteins, other gene products or products of biochemical pathways or in post-translational modifications and any other differences manifested amongst members of a population. A single nucleotide polymorphism (SNP) includes to a polymorphism that arises as the result of a single base change, such as an insertion, deletion or change in a base. A polymorphic marker or site is the locus at which divergence occurs. Such site can be as small as one base pair (an SNP). Polymorphic markers include, but are not limited to, restriction fragment length polymorphisms, variable number of tandem repeats (VNTR's), hypervariable regions, minisatellites, dinucleotide repeats, trinucleotide repeats, tetranucleotide repeats and other repeating patterns, simple sequence repeats and insertional elements, such as Alu. Polymorphic forms also are manifested as different mendelian alleles for a gene. Polymorphisms can be observed by differences in proteins, protein modifications, RNA expression modification, DNA and RNA methylation, regulatory factors that alter gene expression and DNA replication, and any other manifestation of alterations in genomic nucleic acid or organelle nucleic acids.

In some embodiments, these genetic variations can be found to be associated with one or more disorders and/or diseases using the methods disclosed herein. In some embodiments, these genetic variations can be found to be associated with absence of one or more disorders and/or diseases (i.e., the one or more variants are protective against development of the disorder and/or diseases) using the methods disclosed herein. In some embodiments the one or more disorders and/or diseases comprise one or more developmental disorders. In some embodiments the one or more developmental disorders comprise one or more Pervasive Developmental Disorders (PDD). In some embodiments, the one or more PDDs comprise Autism Spectrum Disorder (ASD), also known as autism. In another embodiment, the one or more developmental disorders comprise Pervasive Developmental Disorder—Not Otherwise Specified (PDD-NOS). In some embodiments, PDD can comprise Asperger Syndrome, Rett Syndrome, Fragile X Syndrome and/or Childhood Disintegrative Disorder. In some embodiments genetic variations can be associated with one or more PDDs. In some embodiments genetic variations can be associated with one or more PDD-NOSs.

Scientific evidence suggests there is a potential for various combinations of factors causing ASD, such as multiple genetic variations that may cause autism on their own or when combined with exposure to as yet undetermined environmental factors Timing of exposure during the child's development, such as before, during, or after birth, may also play a role in the development or final presentation of the disorder. A small number of cases can be linked to genetic disorders such as Fragile X, Tuberous Sclerosis, and Angelman's Syndrome, as well as exposure to environmental agents such as infectious ones (maternal rubella or cytomegalovirus) or chemical ones (thalidomide or valproate) during pregnancy.

In some embodiments, these genetic variations comprise point mutations, polymorphisms, single nucleotide polymorphisms (SNPs), single nucleotide variations (SNVs), translocations, insertions, deletions, amplifications, inversions, interstitial deletions, copy number variations (CNVs), loss of heterozygosity, or any combination thereof. As genetic variation includes any deletion, insertion or base substitution of the genomic DNA of one or more individuals in a first portion of a total population which thereby results in a difference at the site of the deletion, insertion or base substitution relative to one or more individuals in a second portion of the total population. Thus, the term "genetic variation" encompasses "wild type" or the most frequently occurring variation, and also includes "mutant," or the less frequently occurring variation.

As used herein, a target molecule that is "associated with" or "correlates with" a particular genetic variation is a molecule that can be functionally distinguished in its structure, activity, concentration, compartmentalization, degradation, secretion, and the like, as a result of such genetic variation. In some embodiments polymorphisms (e.g. polymorphic markers, genetic variations, or genetic variants) can comprise any nucleotide position at which two or more sequences are possible in a subject population. In some embodiments, each version of a nucleotide sequence with respect to the polymorphism can represent a specific allele, of the polymorphism. In some embodiments, genomic DNA from a subject can contain two alleles for any given polymorphic marker, representative of each copy of the marker on each chromosome. In some embodiments, an allele can be a nucleotide sequence of a given location on a chromosome. Polymorphisms can comprise any number of specific alleles. In some embodiments of the disclosure, a polymorphism can be characterized by the presence of two or more alleles in a population. In some embodiments, the polymorphism can be characterized by the presence of three or more alleles. In some embodiments, the polymorphism can be characterized by four or more alleles, five or more alleles, six or more alleles, seven or more alleles, nine or more alleles, or ten or more alleles. In some embodiments an allele can be associated with one or more diseases or disorders, for example, a developmental disorder risk allele can be an allele that is associated with increased or decreased risk of developing a developmental disorder. In some embodiments, genetic variations and alleles can be used to associate an inherited phenotype, for example a developmental disorder, with a responsible genotype. In some embodiments, a developmental disorder risk allele can be a variant allele that is statistically associated with a screening of one or more developmental disorders. In some embodiments, genetic variations can be of any measurable frequency in the population, for example, a frequency higher than 10%, a frequency from 5-10%, a frequency from 1-5%, a frequency from 0.1-1%, or a frequency below 0.1%. As used herein, variant alleles can be alleles that differ from a reference allele. As used herein, a variant can be a segment of DNA that differs from the reference DNA, such as a genetic variation. In some embodiments, genetic variations can be used to track the inheritance of a gene that has not yet been identified, but whose approximate location is known.

As used herein, a "haplotype" can be information regarding the presence or absence of one or more genetic markers in a given chromosomal region in a subject. In some embodiments, a haplotype can be a segment of DNA characterized by one or more alleles arranged along the segment, for example, a haplotype can comprise one member of the pair of alleles for each genetic variation or locus. In some embodiments, the haplotype can comprise two or more alleles, three or more alleles, four or more alleles, five or more alleles, or any combination thereof, wherein, each allele can comprise one or more genetic variations along the segment.

In some embodiments, a genetic variation can be a functional aberration that can alter gene function, gene expression, polypeptide expression, polypeptide function, or any combination thereof. In some embodiments, a genetic variation can be a loss-of-function mutation, gain-of-function mutation, dominant negative mutation, or reversion. In some embodiments, a genetic variation can be part of a gene's coding region or regulatory region. Regulatory regions can control gene expression and thus polypeptide expression. In some embodiments, a regulatory region can be a segment of DNA wherein regulatory polypeptides, for example, transcription or splicing factors, can bind. In some embodiments a regulatory region can be positioned near the gene being regulated, for example, positions upstream or downstream of the gene being regulated. In some embodiments, a regulatory region (e g, enhancer element) can be several thousands of base pairs upstream or downstream of a gene.

In some embodiments, variants can include changes that affect a polypeptide, such as a change in expression level, sequence, function, localization, binding partners, or any combination thereof. In some embodiments, a genetic variation can be a frameshift mutation, nonsense mutation, missense mutation, neutral mutation, or silent mutation. For example, sequence differences, when compared to a reference nucleotide sequence, can include the insertion or deletion of a single nucleotide, or of more than one nucleotide, resulting in a frame shift; the change of at least one nucleotide, resulting in a change in the encoded amino acid; the change of at least one nucleotide, resulting in the generation of a premature stop codon; the deletion of several nucleotides, resulting in a deletion of one or more amino acids encoded by the nucleotides; the insertion of one or several nucleotides, such as by unequal recombination or gene conversion, resulting in an interruption of the coding sequence of a reading frame; duplication of all or a part of a sequence; transposition; or a rearrangement of a nucleotide sequence. Such sequence changes can alter the polypeptide encoded by the nucleic acid, for example, if the change in the nucleic acid sequence causes a frame shift, the frame shift can result in a change in the encoded amino acids, and/or can result in the generation of a premature stop codon, causing generation of a truncated polypeptide. In some embodiments, a genetic variation associated with a developmental disorder can be a synonymous change in one or more nucleotides, for example, a change that does not result in a change in the amino acid sequence. Such a polymorphism can, for example, alter splice sites, affect the stability or transport of mRNA, or otherwise affect the transcription or translation of an encoded polypeptide. In some embodiments, a synonymous mutation can result in the polypeptide product having an altered structure due to rare codon usage that impacts polypeptide folding during translation, which in some cases may alter its function and/or drug binding properties if it is a drug target. In some embodiments, the changes that can alter DNA increase the possibility that structural changes, such as amplifications or deletions, occur at the somatic level. A polypeptide encoded by the reference nucleotide sequence can be a reference polypeptide with a particular reference amino acid sequence, and polypeptides encoded by variant nucleotide sequences can be variant polypeptides with variant amino acid sequences.

In some embodiments, one or more variant polypeptides can be associated with one or more diseases or disorders, such as ASD. In some embodiments, variant polypeptides and changes in expression, localization, and interaction partners thereof, can be used to associate an inherited phenotype, for example, a developmental disorder, with a responsible genotype. In some embodiments, a developmental disorder associated variant polypeptide can be statistically associated with a diagnosis, prognosis, or theranosis of one or more developmental disorders.

The most common sequence variants comprise base variations at a single base position in the genome, and such sequence variants, or polymorphisms, are commonly called single nucleotide polymorphisms (SNPs) or single nucleotide variants (SNVs). In some embodiments, a SNP represents a genetic variant present at greater than or equal to 1% occurrence in a population and in some embodiments a SNP or an SNV can represent a genetic variant present at any frequency level in a population. A SNP can be a nucleotide sequence variation occurring when a single nucleotide at a location in the genome differs between members of a species or between paired chromosomes in a subject. SNPs can include variants of a single nucleotide, for example, at a given nucleotide position, some subjects can have a 'G', while others can have a 'C'. SNPs can occur in a single mutational event, and therefore there can be two possible alleles possible at each SNP site; the original allele and the mutated allele. SNPs that are found to have two different bases in a single nucleotide position are referred to as biallelic SNPs, those with three are referred to as triallelic, and those with all four bases represented in the population are quadallelic. In some embodiments, SNPs can be considered neutral. In some embodiments SNPs can affect susceptibility to developmental disorders. SNP polymorphisms can have two alleles, for example, a subject can be homozygous for one allele of the polymorphism wherein both chromosomal copies of the individual have the same nucleotide at the SNP location, or a subject can be heterozygous wherein the two sister chromosomes of the subject contain different nucleotides. The SNP nomenclature as reported herein is the official Reference SNP (rs) ID identification tag as assigned to each unique SNP by the National Center for Biotechnological Information (NCBI).

Another genetic variation of the disclosure can be copy number variations (CNVs). As used herein, "CNVs" include alterations of the DNA of a genome that results in an abnormal number of copies of one or more sections of DNA. In some embodiments, a CNV comprises a CNV-subregion. As used herein, a "CNV-subregion" includes a continuous nucleotide sequence within a CNV. In some embodiments, the nucleotide sequence of a CNV-subregion can be shorter than the nucleotide sequence of the CNV. CNVs can be inherited or caused by de novo mutation and can be responsible for a substantial amount of human phenotypic variability, behavioral traits, and disease susceptibility. In some embodiments, CNVs of the current disclosure can be associated with susceptibility to one or more developmental disorders, for example, Autism Spectrum Disorder. In some embodiments, CNVs can include a single gene or include a contiguous set of genes. In some embodiments, CNVs can be caused by structural rearrangements of the genome, for example, unbalanced translocations, insertions, deletions, amplifications, and interstitial deletions. In some embodiments, these structural rearrangements occur on one or more chromosomes. Low copy repeats (LCRs), which are region-specific repeat sequences (also known as segmental duplications), can be susceptible to these structural rearrangements, resulting in CNVs. Factors such as size, orientation, percentage similarity and the distance between the copies can influence the susceptibility of LCRs to genomic rearrangement. In addition, rearrangements may be mediated by the presence of high copy number repeats, such as long interspersed elements (LINEs) and short interspersed elements (SINEs), often via non-homologous recombination. For example, chromosomal rearrangements can arise from non-allelic homologous recombination during meiosis or via a replication-based mechanism such as fork stalling and template switching (FoSTeS) (Zhang F. et al., Nat. Genet., 2009) or microhomology-mediated break-induced repair (MMBIR) (Hastings P. J. et al., PLoS Genet., 2009). In some embodiments, CNVs are referred to as structural variants, which are a broader class of variant that also includes copy number neutral alterations such as inversions and balanced translocations. In some embodiments, CNVs are referred to as structural variants. In some embodiments, structural variants can be a broader class of variant that can also include copy number neutral alterations such as inversions and balanced translocations.

CNVs can account for genetic variation affecting a substantial proportion of the human genome, for example, known CNVs can cover over 15% of the human genome sequence (Estivill, X and Armengol, L., PLoS Genetics, 2007). CNVs can affect gene expression, phenotypic variation and adaptation by disrupting or impairing gene dosage, and can cause disease, for example, microdeletion and microduplication disorders, and can confer susceptibility to diseases and disorders. Updated information about the location, type, and size of known CNVs can be found in one or more databases, for example, the Database of Genomic Variants, which currently contains data for over 100,000 CNVs (as of September, 2013).

Other types of sequence variants can be found in the human genome and can be associated with a disease or disorder, including but not limited to, microsatellites. Microsatellite markers are stable, polymorphic, easily analyzed, and can occur regularly throughout the genome, making them especially suitable for genetic analysis. A polymorphic microsatellite can comprise multiple small repeats of bases, for example, CA repeats, at a particular site wherein the number of repeat lengths varies in a population. In some embodiments, microsatellites, for example, variable number of tandem repeats (VNTRs), can be short segments of DNA that have one or more repeated sequences, for example, about 2 to 5 nucleotides long, that can occur in non-coding DNA. In some embodiments, changes in microsatellites can occur during genetic recombination of sexual reproduction, increasing or decreasing the number of repeats found at an allele, or changing allele length.

Developmental Disorders

Developmental disorders are disorders that occur at some stage in a child's development, often retarding the development, including psychological or physical disorders. In some embodiments, they can be distinguished into specific developmental disorders including Pervasive Developmental Disorders (PDDs) and Pervasive Developmental Disorder—Not Otherwise Specified (PDD-NOS). In a preferred embodiment of the present disclosure, a PDD can comprise Autism Spectrum Disorder (ASD). Generally, symptoms that may be present to some degree in a subject of the present disclosure with a PDD can include difficulty with verbal communication, including problems using and understanding language, difficulty with non-verbal communication, such as gestures and facial expressions such as smiling, difficulty with social interaction, including relating to people and to his or her surroundings, unusual ways of playing with toys and other objects, difficulty adjusting to changes in routine or familiar surroundings, repetitive body movements or patterns of behavior, such as hand flapping, spinning, and head banging, changing response to sound, temper tantrums, difficulty sleeping, aggressive behavior, and/or fearfulness or anxiety. ASD can be defined by a certain set of behaviors that can range from the very mild to the severe. Possible indicators of Autism Spectrum Disorders include a subject whom does not babble, point, or make meaningful gestures by 1 year of age; does not speak one word by 16 months, does not combine two words by 2 years, does not respond to their name, and/or loses language or social skills.

As described herein, Pervasive Developmental Disorders—Not Otherwise Specified (PDD-NOS) can comprise Asperger Syndrome, Rett Syndrome, Fragile X Syndrome, and/or Childhood Disintegrative Disorder. In some embodiments a screening of PDD-NOS can be a screening of being on the autism spectrum, but not falling within any of the existing specific categories of autism. PDD-NOS is a pervasive developmental disorder (PDD)/autism spectrum disorder (ASD) and is often referred to as atypical autism.

Subjects

A "subject", as used herein, can be an individual of any age or sex from whom a sample containing nucleotides is obtained for analysis by one or more methods described herein so as to obtain nucleic acid information, for example, a male or female adult, child, newborn, or fetus. In some embodiments, a subject can be any target of therapeutic administration. In some embodiments, a subject can be a test subject or a reference subject. In some embodiments, a subject can be associated with a condition or disease or disorder, asymptomatic or symptomatic, have increased or decreased susceptibility to a disease or disorder, be associated or unassociated with a treatment or treatment regimen, or any combination thereof.

As used herein, a "cohort" can represent an ethnic group, a patient group, a particular age group, a group not associated with a particular disease or disorder, a group associated with a particular disease or disorder, a group of asymptomatic subjects, a group of symptomatic subjects, or a group or subgroup of subjects associated with a particular response to a treatment regimen or clinical trial. In some embodiments, a patient can be a subject afflicted with a disease or disorder. In some embodiments, a patient can be a subject not afflicted with a disease or disorder and is considered apparently healthy, or a normal or control subject. In some embodiments, a subject can be a test subject, a patient or a candidate for a therapeutic, wherein genomic DNA from the subject, patient, or candidate is obtained for analysis by one or more methods of the present disclosure herein, so as to obtain genetic variation information of the subject, patient or candidate.

In some embodiments, the nucleic acid sample can be obtained prenatally from a fetus or embryo or from the mother, for example, from fetal or embryonic cells in the maternal circulation. In some embodiments, the nucleic acid sample can be obtained with the assistance of a health care provider, for example, to draw blood. In some embodiments, the nucleic acid sample can be obtained without the assistance of a health care provider, for example, where the nucleic acid sample is obtained non-invasively, such as a saliva sample, or a sample comprising buccal cells that is obtained using a buccal swab or brush, or a mouthwash sample.

The present disclosure also provides methods for assessing genetic variations in subjects who are members of a target population. Such a target population is in some embodiments a population or group of subjects at risk of developing the disease, based on, for example, other genetic factors, biomarkers, biophysical parameters, diagnostic testing such as magnetic resonance imaging (MRI), family history of a developmental disorder, previous screening or medical history, or any combination thereof.

Although ASD is known to affect children to a higher extent than adults, subjects of all ages are contemplated in the present disclosure. In some embodiments subjects can be from specific age subgroups, such as those over the age of 1, over the age of 2, over the age of 3, over the age of 4, over the age of 5, over the age of 6, over the age of 7, over the age of 8, over the age of 9, over the age of 10, over the age of 15, over the age of 20, over the age of 25, over the age of 30, over the age of 35, over the age of 40, over the age of 45, over the age of 50, over the age of 55, over the age of 60, over the age of 65, over the age of 70, over the age of 75, over the age of 80, or over the age of 85. Other embodiments of the disclosure pertain to other age groups, such as subjects aged less than 85, such as less than age 80, less than age 75, less than age 70, less than age 65, less than age 60, less than age 55, less than age 50, less than age 45, less than age 40, less than age 35, less than age 30, less than age 25, less than age 20, less than age 15, less than age 10, less than age 9, less than age 8, less than age 7, less than age 6, less than age 5, less than age 4, less than age 3, less than age 2, or less than age 1. Other embodiments relate to subjects with age at onset of the disease in any of particular age or age ranges defined by the numerical values described in the above or other numerical values bridging these numbers. It is also contemplated that a range of ages can be relevant in certain embodiments, such as age at onset at more than age 15 but less than age 20. Other age ranges are however also contemplated, including all age ranges bracketed by the age values listed in the above.

The genetic variations of the present disclosure found to be associated with a developmental disorder can show similar association in other human populations. Particular embodiments comprising subject human populations are thus also contemplated and within the scope of the disclosure. Such embodiments relate to human subjects that are from one or more human populations including, but not limited to, Caucasian, Ashkenazi Jewish, Sephardi Jewish, European, American, Eurasian, Asian, Central/South Asian, East Asian, Middle Eastern, African, Hispanic, and Oceanic populations. European populations include, but are not limited to, Swedish, Norwegian, Finnish, Russian, Danish, Icelandic, Irish, Kelt, English, Scottish, Dutch, Belgian, French, German, Spanish, Portuguese, Italian, Polish, Bulgarian, Slavic, Serbian, Bosnian, Czech, Greek and Turkish populations. The ethnic contribution in subjects can also be determined by genetic analysis, for example, genetic analysis of ancestry can be carried out using unlinked microsatellite markers or single nucleotide polymorphisms (SNPs) such as those set out in Smith et al. (Smith M. W. et al., 2004, Am. J. Hum. Genet. 74:1001).

It is also well known to the person skilled in the art that certain genetic variations have different population frequencies in different populations, or are polymorphic in one population but not in another. A person skilled in the art can however apply the methods available and as thought herein to practice the present disclosure in any given human population. This can include assessment of genetic variations of the present disclosure, so as to identify those markers that give strongest association within the specific population. Thus, the at-risk variants of the present disclosure can reside on different haplotype background and in different frequencies in various human populations.

Samples

Samples that are suitable for use in the methods described herein can be nucleic acid samples from a subject. A "nucleic acid sample" as used herein can include RNA, DNA, polypeptides, or a combination thereof. Nucleic acids and polypeptides can be extracted from one or more nucleic acid samples including but not limited to, blood, saliva, urine, mucosal scrapings of the lining of the mouth, expectorant, serum, tears, skin, tissue, or hair. A nucleic acid sample can be assayed for nucleic acid information. "Nucleic acid information," as used herein, includes a nucleic acid sequence itself, the presence/absence of genetic variation in the nucleic acid sequence, a physical property which varies depending on the nucleic acid sequence (for example, Tm), and the amount of the nucleic acid (for example, number of mRNA copies). A "nucleic acid" means any one of DNA, RNA, DNA including artificial nucleotides, or RNA including artificial nucleotides. As used herein, a "purified nucleic acid" includes cDNAs, fragments of genomic nucleic acids, nucleic acids produced polymerase chain reaction (PCR), nucleic acids formed by restriction enzyme treatment of genomic nucleic acids, recombinant nucleic acids, and chemically synthesized nucleic acid molecules. A "recombinant" nucleic acid molecule includes a nucleic acid molecule made by an artificial combination of two otherwise separated segments of sequence, e.g., by chemical synthesis or by the manipulation of isolated segments of nucleic acids by genetic engineering techniques. As used herein, a "polypeptide" includes proteins, fragments of proteins, and peptides, whether isolated from natural sources, produced by recombinant techniques, or chemically synthesized. A polypeptide may have one or more modifications, such as a post-translational modification (e.g., glycosylation, etc.) or any other modification (e.g., pegylation, etc.). The polypeptide may contain one or more non-naturally-occurring amino acids (e.g., such as an amino acid with a side chain modification).

In some embodiments, the nucleic acid sample can comprise cells or tissue, for example, cell lines. Exemplary cell types from which nucleic acids can be obtained using the methods described herein and include but are not limited to, a blood cell; such as a B lymphocyte, T lymphocyte, leukocyte, erythrocyte, macrophage, or neutrophil; a muscle cell such as a skeletal cell, smooth muscle cell or cardiac muscle cell; a germ cell, such as a sperm or egg; an epithelial cell; a connective tissue cell, such as an adipocyte, chondrocyte; fibroblast or osteoblast; a neuron; an astrocyte; a stromal cell; an organ specific cell, such as a kidney cell, pancreatic cell, liver cell, or a keratinocyte; a stem cell; or any cell that develops there from. A cell from which nucleic acids can be obtained can be a blood cell or a particular type of blood cell including, for example, a hematopoietic stem cell or a cell that arises from a hematopoietic stem cell such as a red blood cell, B lymphocyte, T lymphocyte, natural killer cell, neutrophil, basophil, eosinophil, monocyte, macrophage, or platelet. Generally any type of stem cell can be used including, without limitation, an embryonic stem cell, adult stem cell, or pluripotent stem cell.

In some embodiments, a nucleic acid sample can be processed for RNA or DNA isolation, for example, RNA or DNA in a cell or tissue sample can be separated from other components of the nucleic acid sample. Cells can be harvested from a nucleic acid sample using standard techniques known in the art, for example, by centrifuging a cell sample and resuspending the pelleted cells, for example, in a buffered solution, for example, phosphate-buffered saline (PBS). In some embodiments, after centrifuging the cell suspension to obtain a cell pellet, the cells can be lysed to extract DNA. In some embodiments, the nucleic acid sample can be concentrated and/or purified to isolate DNA. All nucleic acid samples obtained from a subject, including those subjected to any sort of further processing, are considered to be obtained from the subject. In some embodiments, standard techniques and kits known in the art can be used to extract RNA or DNA from a nucleic acid sample, including, for example, phenol extraction, a QIAamp® Tissue Kit (Qiagen, Chatsworth, Calif.), a Wizard® Genomic DNA purification kit (Promega), or a Qiagen Autopure method using Puregene chemistry, which can enable purification of highly stable DNA well-suited for archiving.

In some embodiments, determining the identity of an allele or determining copy number can, but need not, include obtaining a nucleic acid sample comprising RNA and/or DNA from a subject, and/or assessing the identity, copy number, presence or absence of one or more genetic variations and their chromosomal locations within the genomic DNA (i.e., subject's genome) derived from the nucleic acid sample.

The individual or organization that performs the determination need not actually carry out the physical analysis of a nucleic acid sample from a subject. In some embodiments, the methods can include using information obtained by analysis of the nucleic acid sample by a third party. In some embodiments, the methods can include steps that occur at more than one site. For example, a nucleic acid sample can be obtained from a subject at a first site, such as at a health care provider or at the subject's home in the case of a self-testing kit. The nucleic acid sample can be analyzed at the same or a second site, for example, at a laboratory or other testing facility.

Methods of Screening

As used herein, screening a subject comprises diagnosing or determining, theranosing, or determining the susceptibility to developing (prognosing) a developmental disorder, for example, ASD. In particular embodiments, the disclosure is a method of determining a presence of, or a susceptibility to, a developmental disorder, by detecting at least one genetic variation in a sample from a subject as described herein. In some embodiments, detection of particular alleles, markers, variations, or haplotypes is indicative of a presence or susceptibility to a developmental disorder. Although there can be many concerns about screening a subject with an ASD, the earlier the screening of ASD is made, the earlier needed interventions can begin. Evidence over the last 15 years indicates that intensive early intervention in optimal educational settings for at least 2 years during the preschool years results in improved outcomes in most young children with ASD. In evaluating a child, clinicians rely on behavioral characteristics to make a diagnosis, prognosis, or theranosis. Some of the characteristic behaviors of ASD may be apparent in the first few months of a child's life, or they may appear at any time during the early years. For the screening problems in at least one of the areas of communication, socialization, or restricted behavior must be present before the age of 3. The screening requires a two-stage process. The first stage involves developmental screening during "well-child" check-ups; the second stage entails a comprehensive evaluation by a multidisciplinary team. A "well child" check-up should include a developmental screening test. Several screening instruments have been developed to quickly gather information about a child's social and communicative development within medical settings. Among them are the Checklist of Autism in Toddlers (CHAT), the modified Checklist for Autism in Toddlers (M-CHAT), the Screening Tool for Autism in Two-Year-Olds (STAT), and the Social Communication Questionnaire (SCQ) for children 4 years of age and older. Some screening instruments rely solely on parent responses to a questionnaire, and some rely on a combination of parent report and observation. Key items on these instruments that appear to differentiate children with autism from other groups before the age of 2 include pointing and pretend play. Screening instruments do not provide individual diagnosis, prognosis, or theranosis, but serve to assess the need for referral for possible screening of ASD. These screening methods may not identify children with mild ASD, such as those with high-functioning autism or Asperger syndrome. The second stage of screening must be comprehensive in order to accurately rule in or rule out an ASD or other developmental problem. This evaluation may be done by a multidisciplinary team that includes a psychologist, a neurologist, a psychiatrist, a speech therapist, or other professionals who screen children with ASD. Because ASDs are complex disorders and may involve other developmental or genetic problems, a comprehensive evaluation should entail developmental and genetic assessment, along with in-depth cognitive and language testing. In addition, measures developed specifically for screening autism are often used. These include the Autism Diagnosis Interview-Revised (ADI-R) and the Autism Diagnostic Observation Schedule (ADOS-G). The ADI-R is a structured interview that contains over 100 items and is conducted with a caregiver. It consists of four main factors including the child's communication, social interaction, repetitive behaviors, and age-of-onset symptoms. The ADOS-G is an observational measure used to "press" for socio-communicative behaviors that are often delayed, abnormal, or absent in children with ASD. Still another instrument often used by professionals is the Childhood Autism Rating Scale (CARS). It can aid in evaluating the child's body movements, adaptation to change, listening response, verbal communication, and relationship to people. It is suitable for use with children over 2 years of age. The examiner observes the child and also obtains relevant information from the parents. The child's behavior is rated on a scale based on deviation from the typical behavior of children of the same age. Two other tests that can be used to assess any child with a developmental delay are a formal audiologic hearing evaluation and a lead screening. Although some hearing loss can co-occur with ASD, some children with ASD may be incorrectly thought to have such a loss. In addition, if the child has suffered from an ear infection, transient hearing loss can occur. Lead screening is essential for children who remain for a long period of time in the oral-motor stage in which they put any and everything into their mouths. Children with an autistic disorder usually have elevated blood lead levels. Customarily, an expert screening team has the responsibility of thoroughly evaluating the child, assessing the child's unique strengths and weaknesses, and determining a formal screen. The team will then meet with the parents to explain the results of the evaluation.

PDD-NOS is typically screened by psychologists and Pediatric Neurologists. No singular specific test can be administered to determine whether or not a child is on the spectrum. Screening can be made through observations, questionnaires, and tests. A parent will usually initiate the quest into the screening with questions for their child's pediatrician about their child's development after noticing abnormalities. From there, doctors will ask questions to gauge the child's development in comparison to age-appropriate milestones. One test that measures this is the Modified Checklist of Autism in Toddlers (MCHAT). This is a list of questions whose answers will determine whether or not the child should be referred to a specialist such as a developmental pediatrician, a neurologist, a psychiatrist, or a psychologist. Another checklist, the DSM-IV is a series of characteristics and criteria to qualify for an autism diagnosis. Because PDD-NOS is a spectrum disorder, not every child shows the same signs. The two main characteristics of the disorder are difficulties with social interaction skills and communication. Signs are often visible in babies but a diagnosis is usually not made until around age 4. Even though PDD-NOS is considered milder than typical autism, this is not always true. While some characteristics may be milder, others may be more severe. Once a child with PDD-NOS enters school, he or she will often be very eager to interact with classmates, but may act socially different to peers and be unable to make genuine connections. As they age, the closest connections they make are typically with their parents. Children with PDD-NOS have difficulty reading facial expressions and relating to feelings of others. They may not know how to respond when someone is laughing or crying. Literal thinking is also characteristic of PDD-NOS. They will most likely have difficulty understanding figurative speech and sarcasm Inhibited communication skills are a sign of PDD-NOS that begins immediately after birth. As an infant, they will not babble, and as they age, they do not speak when age appropriate. Once verbal communication begins, their vocabulary is often limited. Some characteristics of language-based patterns are: repetitive or rigid language, narrow interests, uneven language development, and poor nonverbal communication. A very common characteristic of PDD-NOS is severe difficulty grasping the difference between pronouns, particularly between "you" and "me" when conversing. During the last few years, screening instruments have been devised to screen for Asperger syndrome and higher functioning autism. The Autism Spectrum Screening Questionnaire (ASSQ), the Australian Scale for Asperger's Syndrome, and the most recent, the Childhood Asperger Syndrome Test (CAST), are some of the instruments that are reliable for identification of school-age children with Asperger syndrome or higher functioning autism. These tools concentrate on social and behavioral impairments in children without significant language delay. If, following the screening process or during a routine "well child" check-up, a subject's doctor sees any of the possible indicators of ASD, further evaluation is indicated.

While means for screening ASDs exist, many times symptoms go unnoticed until late in childhood or symptoms are so minor they are left unnoticed. Thus there exists a need for an improved ASD screening test. Described herein are methods of screening an individual for one or more developmental disorders, including but not limited to, determining the identity and location of genetic variations, such as variations in nucleotide sequence and copy number, and the presence or absence of alleles or genotypes in one or more samples from one or more subjects using any of the methods described herein. In some embodiments, determining an association to having or developing a developmental disorder can be performed by detecting particular variations that appear more frequently in test subjects compared to reference subjects and analyzing the molecular and physiological pathways these variations can affect.

Within any given population, there can be an absolute susceptibility of developing a disease or trait, defined as the chance of a person developing the specific disease or trait over a specified time-period. Susceptibility (e.g. being at-risk) is typically measured by looking at very large numbers of people, rather than at a particular individual. As described herein, certain copy number variations (genetic variations) are found to be useful for susceptibility assessment of a developmental disorder. Susceptibility assessment can involve detecting particular genetic variations in the genome of individuals undergoing assessment. Particular genetic variations are found more frequently in individuals with a developmental disorder, than in individuals without a developmental disorder. Therefore, these genetic variations have predictive value for detecting a developmental disorder, or a susceptibility to a developmental disorder, in an individual. Without intending to be limited by theory, it is believed that the genetic variations described herein to be associated with susceptibility of a developmental disorder represent functional variants predisposing to the disease. In some embodiments, a genetic variation can confer a susceptibility of the condition, for example carriers of the genetic variation are at a different risk of the condition than non-carriers. In some embodiments, the presence of a genetic variation is indicative of increased susceptibility to a developmental disorder, such as Autism Spectrum Disorder.

In some embodiments, screening can be performed using any of the methods disclosed, alone or in combination. In some embodiments, screening can be performed using Polymerase Chain Reaction (PCR). In some embodiments screening can be performed using Array Comparative Genomic Hybridization (aCGH) to detect CNVs. In another preferred embodiment screening can be performed using exome sequencing to detect SNVs, indels, and in some cases CNVs using appropriate analysis algorithms. In another preferred embodiment screening is performed using high-throughput (also known as next generation) whole genome sequencing methods and appropriate algorithms to detect all or nearly all genetic variations present in a genomic DNA sample. In some embodiments, the genetic variation information as it relates to the current disclosure can be used in conjunction with any of the above mentioned symptomatic screening tests to screen a subject for ASD, for example, using a combination of aCGH and a childhood screening test, such as the Checklist of Autism in Toddlers (CHAT).

In some embodiments, information from any of the above screening methods (e.g. specific symptoms, scoring matrix, or genetic variation data) can be used to define a subject as a test subject or reference subject. In some embodiments, information from any of the above screening methods can be used to associate a subject with a test or reference population, for example, a subject in a population. In the present study, for example, all the probands in Table 1 met the criteria for autism on one or both of the screening measures including the Autism Diagnostic Interview-Revised (ADI-R) training and the Autism Diagnostic Observation Schedule (ADOS) training.

In one embodiment, an association with a developmental disorder can be determined by the statistical likelihood of the presence of a genetic variation in a subject with a developmental disorder, for example, an unrelated individual or a first or second-degree relation of the subject. In some embodiments, an association with a developmental disorder can be determined by determining the statistical likelihood of the absence of a genetic variation in an unaffected reference subject, for example, an unrelated individual or a first or second-degree relation of the subject. The methods described herein can include obtaining and analyzing a nucleic acid sample from one or more suitable reference subjects.

In the present context, the term screening comprises diagnosis, prognosis, and theranosis. Screening can refer to any available screening method, including those mentioned herein. As used herein, susceptibility can be proneness of a subject towards the development of a developmental condition, or towards being less able to resist a particular developmental condition than one or more control subjects. In some embodiments, susceptibility can encompass increased susceptibility. For example, particular nucleic acid variations of the disclosure as described herein can be characteristic of increased susceptibility to development of a developmental disorder. In some embodiments, particular nucleic acid variations can confer decreased susceptibility, for example particular nucleic variations of the disclosure as described herein can be characteristic of decreased susceptibility to development of a developmental disorder.

As described herein, a genetic variation predictive of susceptibility to or presence of a developmental disorder can be one where the particular genetic variation is more frequently present in a group of subjects with the condition (affected), compared to the frequency of its presence in a reference group (control), such that the presence of the genetic variation is indicative of susceptibility to or presence of the developmental disorder. In some embodiments, the reference group can be a population nucleic acid sample, for example, a random nucleic acid sample from the general population or a mixture of two or more nucleic acid samples from a population. In some embodiments, disease-free controls can be characterized by the absence of one or more specific disease-associated symptoms, for example, individuals who have not experienced symptoms associated with a developmental disorder. In some embodiments, the disease-free control group is characterized by the absence of one or more disease-specific risk factors, for example, at least one genetic and/or environmental risk factor. In some embodiments, a reference sequence can be referred to for a particular site of genetic variation. In some embodiments, a reference allele can be a wild-type allele and can be chosen as either the first sequenced allele or as the allele from a control individual. In some embodiments, one or more reference subjects can be characteristically matched with one or more affected subjects, for example, with matched aged, gender or ethnicity.

A person skilled in the art can appreciate that for genetic variations with two or more alleles present in the population being studied, and wherein one allele can found in increased frequency in a group of individuals with a developmental disorder in the population, compared with controls, the other allele of the marker can be found in decreased frequency in the group of individuals with the trait or disease, compared with controls. In such a case, one allele of the marker, for example, the allele found in increased frequency in individuals with a developmental disorder, can be the at-risk allele, while the other allele(s) can be a neutral or protective allele.

A genetic variant associated with a developmental disorder can be used to predict the susceptibility of the disease for a given genotype. For any genetic variation, there can be one or more possible genotypes, for example, homozygote for the at-risk variant (e.g., in autosomal recessive disorders), heterozygote, and non-carrier of the at-risk variant. Autosomal recessive disorders can also result from two distinct genetic variants impacting the same gene such that the individual is a compound heterozygote (e.g., the maternal allele contains a different mutation than the paternal allele). Compound heterozygosity may result from two different SNVs, two different CNVs, an SNV and a CNV, or any combination of two different genetic variants but each present on a different allele for the gene. For X-linked genes, males who possess one copy of a variant-containing gene may be affected, while carrier females, who also possess a wild-type gene, may remain unaffected. In some embodiments, susceptibility associated with variants at multiple loci can be used to estimate overall susceptibility. For multiple genetic variants, there can be k ($k=3^n*2^p$) possible genotypes; wherein n can be the number of autosomal loci and p can be the number of gonosomal (sex chromosomal) loci. Overall susceptibility assessment calculations can assume that the relative susceptibilities of different genetic variants multiply, for example, the overall susceptibility associated with a particular genotype combination can be the product of the susceptibility values for the genotype at each locus. If the susceptibility presented is the relative susceptibility for a person, or a specific genotype for a person, compared to a reference population, then the combined susceptibility can be the product of the locus specific susceptibility values and can correspond to an overall susceptibility estimate compared with a population. If the susceptibility for a person is based on a comparison to non-carriers of the at-risk allele, then the combined susceptibility can correspond to an estimate that compares the person with a given combination of genotypes at all loci to a group of individuals who do not carry at-risk variants at any of those loci. The group of non-carriers of any at-risk variant can have the lowest estimated susceptibility and can have a combined susceptibility, compared with itself, for example, non-carriers, of 1.0, but can have an overall susceptibility, compared with the population, of less than 1.0.

Overall risk for multiple risk variants can be performed using standard methodology. Genetic variations described herein can form the basis of risk analysis that combines other genetic variations known to increase risk of a developmental disorder, or other genetic risk variants for a developmental disorder. In certain embodiments of the disclosure, a plurality of variants (genetic variations, variant alleles, and/or haplotypes) can be used for overall risk assessment. These variants are in some embodiments selected from the genetic variations as disclosed herein. Other embodiments include the use of the variants of the present disclosure in combination with other variants known to be useful for screening a susceptibility to a developmental disorder. In such embodiments, the genotype status of a plurality of genetic variations, markers and/or haplotypes is determined in an individual, and the status of the individual compared with the population frequency of the associated variants, or the frequency of the variants in clinically healthy subjects, such as age-matched and sex-matched subjects.

Methods such as the use of available algorithms and software can be used to identify, or call, significant genetic variations, including but not limited to, algorithms of DNA Analytics or DNAcopy, iPattern and/or QuantiSNP. In some embodiments, a threshold logratio value can be used to determine losses and gains. For example, using DNA Analytics, a $\log_2$ ratio cutoff of $\geq 0.25$ and $\leq 0.25$ to classify CNV gains and losses respectively can be used. As a further example, using DNAcopy, a $\log_2$ ratio cutoff of $\geq 0.35$ and $\leq 0.35$ to classify CNV gains and losses respectively can be used. For example, an Aberration Detection Module 2 (ADM2) algorithm, such as that of DNA Analytics 4.0.85 can be used to identify, or call, significant genetic variations. In some embodiments, two or more algorithms can be used to identify, or call, significant genetic variations. For example, 2, 3, 4, 5, 6, 7, 8, 9, or 10 or more algorithms can be used to identify, or call, significant genetic variations. In some embodiments, significant genetic variations can be CNVs.

CNVs detected by 2 or more algorithms can be defined as stringent and can be utilized for further analyses. In some embodiments, the information and calls from two or more of the methods described herein can be compared to each other to identify significant genetic variations more or less stringently. For example, CNV calls generated by two or more of DNA Analytics, Aberration Detection Module 2 (ADM2)

algorithms, and DNAcopy algorithms can be defined as stringent CNVs. In some embodiments significant or stringent genetic variations can be tagged as identified or called if it can be found to have a minimal reciprocal overlap to a genetic variation detected by one or more platforms and/or methods described herein. For example, a minimum of 50% reciprocal overlap can be used to tag the CNVs as identified or called. For example, significant or stringent genetic variations can be tagged as identified or called if it can be found to have a reciprocal overlap of more than about 50%, 55% 60%, 65%, 70%, 75%, 80%, 85%, 90%, or 95%, 99%, or equal to 100%, to a genetic variation detected by one or more platforms and/or methods described herein. For example, significant or stringent genetic variations can be tagged as identified or called if it can be found to have a reciprocal overlap of more than about 50% reciprocal overlap to a genetic variation detected by one or more platforms and/or methods described herein. In another embodiment, genetic variations can be detected from the log 2 ratio values calculated for individual probes present on an aCGH microarray via a statistical comparison of the probe's log 2 ratio value in a cohort of subjects with the disease or developmental disorder (e.g., autism) to the probe's log 2 ratio value in a cohort of subjects without the disease or developmental disorder (e.g., autism).

In some embodiments, a threshold log ratio value can be used to determine losses and gains. A log ratio value can be any log ratio value; for example, a log ratio value can be a log 2 ratio or a log 10 ratio. In some embodiments, a CNV segment whose median log 2 ratio is less than or equal to a log 2 ratio threshold value can be classified as a loss. For example, any segment whose median log 2 ratio is less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20 or less, can be classified as a loss.

In some embodiments, one algorithm can be used to call or identify significant genetic variations, wherein any segment whose median log 2 ratio was less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20 or less, can be classified as a loss. For example, any CNV segment whose median log 2 ratio is less than −0.35 as determined by DNAcopy can be classified as a loss. For example, losses can be determined according to a threshold log 2 ratio, which can be set at −0.35.

In some embodiments, two algorithms can be used to call or identify significant genetic variations, wherein any segment whose median log 2 ratio is less than or equal to −0.1, −0.11, −0.12, −0.13, −0.14, −0.15, −0.16, −0.17, −0.18, −0.19, −0.2, −0.21, −0.22, −0.23, −0.24, −0.25, −0.26, −0.27, −0.28, −0.29, −0.3, −0.31, −0.32, −0.33, −0.34, −0.35, −0.36, −0.37, −0.38, −0.39, −0.4, −0.41, −0.42, −0.43, −0.44, −0.45, −0.46, −0.47, −0.48, −0.49, −0.5, −0.55, −0.6, −0.65, −0.7, −0.75, −0.8, −0.85, −0.9, −0.95, −1, −1.1, −1.2, −1.3, −1.4, −1.5, −1.6, −1.7, −1.8, −1.9, −2, −2.1, −2.2, −2.3, −2.4, −2.5, −2.6, −2.7, −2.8, −2.9, −3, −3.1, −3.2, −3.3, −3.4, −3.5, −3.6, −3.7, −3.8, −3.9, −4, −4.1, −4.2, −4.3, −4.4, −4.5, −4.6, −4.7, −4.8, −4.9, −5, −5.5, −6, −6.5, −7, −7.5, −8, −8.5, −9, −9.5, −10, −11, −12, −13, −14, −15, −16, −17, −18, −19, −20, or less, as determined by the other algorithm can be classified as a loss. For example, CNV calling can comprise using the Aberration Detection Module 2 (ADM2) algorithm and the DNAcopy algorithm, wherein losses can be determined according to a two threshold log 2 ratios, wherein the Aberration Detection Module 2 (ADM2) algorithm log 2 ratio can be −0.25 and the DNAcopy algorithm log 2 ratio can be −0.41.

In some embodiments, the use of two algorithms to call or identify significant genetic variations can be a stringent method. In some embodiments, the use of two algorithms to call or identify significant genetic variations can be a more stringent method compared to the use of one algorithm to call or identify significant genetic variations.

In some embodiments, any CNV segment whose median log 2 ratio is greater than a log 2 ratio threshold value can be classified as a gain. For example, any segment whose median log 2 ratio is greater than 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, or more can be classified as a gain.

In some embodiments, one algorithm can be used to call or identify significant genetic variations, wherein any segment whose median log 2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, or more can be classified as a gain. For example, any CNV segment whose median log 2 ratio is greater than 0.35 as determined by DNAcopy can be classified as a gain. For example, gains can be determined according to a threshold log 2 ratio, which can be set at 0.35.

In some embodiments, two algorithms can be used to call or identify significant genetic variations, wherein any segment whose median log 2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, or 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3 or more, as determined by one algorithm, and wherein any segment whose median log 2 ratio is greater than or equal to 0.1, 0.11, 0.12, 0.13, 0.14, 0.15, 0.16, 0.17, 0.18, 0.19, 0.2, 0.21, 0.22, 0.23, 0.24, 0.25, 0.26, 0.27, 0.28, 0.29, 0.3, 0.31, 0.32, 0.33, 0.34, 0.35, 0.36, 0.37, 0.38, 0.39, 0.4, 0.41, 0.42, 0.43, 0.44, 0.45, 0.46, 0.47, 0.48, 0.49, or 0.5, 0.55, 0.6, 0.65, 0.7, 0.75, 0.8, 0.85, 0.9, 0.95, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, or more, as determined by the other algorithm the can be classified as a gain. For example, CNV calling can comprise using the Aberration Detection Module 2 (ADM2) algorithm and the DNAcopy algorithm, wherein gains can be determined according to a two threshold log 2 ratios, wherein the Aberration Detection Module 2 (ADM2) algorithm log 2 ratio can be 0.25 and the DNAcopy algorithm log 2 ratio can be 0.32.

Any CNV segment whose absolute (median log-ratio/mad) value is less than 2 can be excluded (not identified as a significant genetic variation). For example, any CNV segment whose absolute (median log-ratio/mad) value is less than 2, 1.9, 1.8, 1.7, 1.6, 1.5, 1.4, 1.3, 1.2, 1.1, 1, 0.9, 0.8, 0.7, 0.6, or 0.5 or less can be excluded.

In some embodiments, multivariate analyses or joint risk analyses, including the use of multiplicative model for overall risk assessment, can subsequently be used to determine the overall risk conferred based on the genotype status at the multiple loci. Use of a multiplicative model, for example, assuming that the risk of individual risk variants multiply to establish the overall effect, allows for a straightforward calculation of the overall risk for multiple markers. The multiplicative model is a parsimonious model that usually fits the data of complex traits reasonably well. Deviations from multiplicity have been rarely described in the context of common variants for common diseases, and if reported are usually only suggestive since very large sample sizes can be required to be able to demonstrate statistical interactions between loci. Assessment of risk based on such analysis can subsequently be used in the methods, uses and kits of the disclosure, as described herein.

In some embodiments, the significance of increased or decreased susceptibility can be measured by a percentage. In some embodiments, a significant increased susceptibility can be measured as a relative susceptibility of at least 1.2, including but not limited to: at least 1.3, at least 1.4, at least 1.5, at least 1.6, at least 1.7, at least 1.8, at least 1.9, at least 2.0, at least 2.5, at least 3.0, at least 4.0, at least 5.0, at least 6.0, at least 7.0, at least 8.0, at least 9.0, at least 10.0, and at least 15.0. In some embodiments, a relative susceptibility of at least 2.0, at least 3.0, at least 4.0, at least, 5.0, at least 6.0, or at least 10.0 is significant. Other values for significant susceptibility are also contemplated, for example, at least 2.5, 3.5, 4.5, 5.5, or any suitable other numerical values, wherein the values are also within scope of the present disclosure. In some embodiments, a significant increase in susceptibility is at least about 20%, including but not limited to about 25%, 30%, 35%, 40%, 45%, 50%, 55%, 60%, 65%, 70%, 75%, 80%, 85%, 90%, 95%, 100%, 150%, 200%, 300%, 400%, 500%, 600%, 700%, 800%, 900%, 1000%, and 1500%. In one particular embodiment, a significant increase in susceptibility is at least 100%. In other embodiments, a significant increase in susceptibility is at least 200%, at least 300%, at least 400%, at least 500%, at least 700%, at least 800%, at least 900% and at least 1000%. Other cutoffs or ranges as deemed suitable by the person skilled in the art to characterize the disclosure are also contemplated, and those are also within scope of the present disclosure. In certain embodiments, a significant increase in susceptibility is characterized by a p-value, such as a p-value of less than 0.5, less than 0.4, less than 0.3, less than 0.2, less than 0.1, less than 0.05, less than 0.01, less than 0.001, less than 0.0001, less than 0.00001, less than 0.000001, less than 0.0000001, less than 0.00000001, or less than 0.000000001.

In some embodiments, an individual who is at a decreased susceptibility for or the lack of presence of a developmental condition can be an individual in whom at least one genetic variation, conferring decreased susceptibility for or the lack of presence of the developmental disorder is identified. In some embodiments, the genetic variations conferring decreased susceptibility are also protective. In one aspect, the genetic variations can confer a significant decreased susceptibility of or lack of presence of the developmental disorder.

In some embodiments, significant decreased susceptibility can be measured as a relative susceptibility of less than 0.9, including but not limited to less than 0.9, less than 0.8, less than 0.7, less than 0.6, less than 0.5, less than 0.4, less than 0.3, less than 0.2 and less than 0.1. In some embodiments, the decrease in susceptibility is at least 20%, including but not limited to at least 25%, at least 30%, at least 35%, at least 40%, at least 45%, at least 50%, at least 55%, at least 60%, at least 65%, at least 70%, at least 75%, at least 80%, at least 85%, at least 90%, at least 95% and at least 98%. Other cutoffs or ranges as deemed suitable by the person, skilled in the art to characterize the disclosure are however also contemplated, and those are also within scope of the present disclosure. In certain embodiments, a significant decrease in susceptibility is characterized by a p-value, such as a p-value of less than 0.05, less than 0.01, less than 0.001, less than 0.0001, less than 0.00001, less than 0.000001, less than 0.0000001, less than 0.00000001, or less than 0.000000001. Other tests for significance can be used, for example, a Fisher-exact test. Other statistical tests of significance known to the skilled person are also contemplated and are also within scope of the disclosure.

In some preferred embodiments, the significance of increased or decreased susceptibility can be determined according to the ratio of measurements from a test subject to a reference subject. In some embodiments, losses or gains of one or more CNVs can be determined according to a threshold $\log_2$ ratio determined by these measurements. In some embodiments, a $\log_2$ ratio value greater than 0.35 is indicative of a gain of one or more CNVs. In some embodiments, a $\log_2$ ratio value less than −0.35 is indicative of a loss of one or more CNVs. In some embodiments, the ratio of measurements from a test subject to a reference subject may be inverted such that the log 2 ratios of copy number gains are negative and the log 2 ratios of copy number losses are positive.

In some embodiments, the combined or overall susceptibility associated with a plurality of variants associated with a developmental disorder can also be assessed; for example, the genetic variations described herein to be associated with susceptibility to a developmental disorder can be combined with other common genetic risk factors. Combined risk for such genetic variants can be estimated in an analogous fashion to the methods described herein.

Calculating risk conferred by a particular genotype for the individual can be based on comparing the genotype of the individual to previously determined risk expressed, for example, as a relative risk (RR) or an odds ratio (OR), for the genotype, for example, for a heterozygous carrier of an at-risk variant for a developmental disorder. An odds ratio can be a statistical measure used as a metric of causality. For example, in genetic disease research it can be used to convey the significance of a variant in a disease cohort relative to an unaffected/normal cohort. The calculated risk for the individual can be the relative risk for a subject, or for a specific genotype of a subject, compared to the average population. The average population risk can be expressed as a weighted average of the risks of different genotypes, using results from a reference population, and the appropriate calculations to calculate the risk of a genotype group relative to the population can then be performed. Alternatively, the risk for an individual can be based on a comparison of particular genotypes, for example, heterozygous and/or homozygous carriers of an at-risk allele of a marker compared with non-carriers of the at-risk allele. Using the population average can, in certain embodiments, be more convenient, since it provides a measure that can be easy to interpret for the user, for example, a measure that gives the risk for the individual, based on his/her genotype, compared with the average in the population.

In some embodiments, the OR value can be calculated as follows: $OR=(A/(N1-A))/(U/(N2-U))$, where A=number of affected cases with variant, N1=total number of affected cases, U=number of unaffected cases with variant and N2=total number of unaffected cases. In circumstances where U=0, it is conventional to set U=1, so as to avoid infinities. In some preferred embodiments the OR can be calculated essentially as above, except that where U OR A=0, 0.5 is added to all of A, N1, U, N2. In another embodiment, a Fisher's Exact Test (FET) can be calculated using standard methods. In another embodiment, the p-values can be corrected for false discovery rate (FDR) using the Benjamini-Hochberg method (Benjamini Y. and Hochberg Y. 1995 J. Royal Statistical Society 57:289; Osborne J. A. and Barker C. A. 2007).

In certain embodiments of the disclosure, a genetic variation is correlated to a developmental disorder by referencing genetic variation data to a look-up table that comprises correlations between the genetic variation and a developmental disorder. The genetic variation in certain embodiments comprises at least one indication of the genetic variation. In some embodiments, the table comprises a correlation for one genetic variation. In other embodiments, the table comprises a correlation for a plurality of genetic variations. In both scenarios, by referencing to a look-up table that gives an indication of a correlation between a genetic variation and a developmental disorder, a risk for a developmental disorder, or a susceptibility to a developmental disorder, can be identified in the individual from whom the nucleic acid sample is derived.

The present disclosure also pertains to methods of clinical screening, for example, diagnosis, prognosis, or theranosis of a subject performed by a medical professional using the methods disclosed herein. In other embodiments, the disclosure pertains to methods of screening performed by a layman. The layman can be a customer of a genotyping, microarray, exome sequencing, or whole genome sequencing service provider. The layman can also be a genotype, microarray, exome sequencing, or whole genome sequencing service provider, who performs genetic analysis on a DNA sample from an individual, in order to provide service related to genetic risk factors for particular traits or diseases, based on the genotype status of the subject obtained from use of the methods described herein. The resulting genotype or genetic information can be made available to the individual and can be compared to information about developmental disorders or risk of developing a developmental disorder associated with one or various genetic variations, including but not limited to, information from public or private genetic variation databases or literature and scientific publications. The screening applications of developmental disorder-associated genetic variations, as described herein, can, for example, be performed by an individual, a health professional, or a third party, for example a service provider who interprets genotype information from the subject. In some embodiments the genetic analysis is performed in a CLIA-certified laboratory (i.e., the federal regulatory standards the U.S. that are specified in the Clinical Laboratory Improvement Amendments, administered by the Centers for Medicare and Medicaid Services) or equivalent laboratories in Europe and elsewhere in the world.

The information derived from analyzing sequence data can be communicated to any particular body, including the individual from which the nucleic acid sample or sequence data is derived, a guardian or representative of the individual, clinician, research professional, medical professional, service provider, and medical insurer or insurance company. Medical professionals can be, for example, doctors, nurses, medical laboratory technologists, and pharmacists. Research professionals can be, for example, principle investigators, research technicians, postdoctoral trainees, and graduate students.

In some embodiments, a professional can be assisted by determining whether specific genetic variants are present in a nucleic acid sample from a subject, and communicating information about genetic variants to a professional. After information about specific genetic variants is reported, a medical professional can take one or more actions that can affect subject care. For example, a medical professional can record information in the subject's medical record regarding the subject's risk of developing a developmental disorder. In some embodiments, a medical professional can record information regarding risk assessment, or otherwise transform the subject's medical record, to reflect the subject's current medical condition. In some embodiments, a medical professional can review and evaluate a subject's entire medical record and assess multiple treatment strategies for clinical intervention of a subject's condition.

A medical professional can initiate or modify treatment after receiving information regarding a subject's screening of a developmental disorder, for example. In some embodiments, a medical professional can recommend a change in therapy. In some embodiments, a medical professional can enroll a subject in a clinical trial for, by way of example, detecting correlations between a haplotype as described herein and any measurable or quantifiable parameter relating to the outcome of the treatment as described above.

In some embodiments, a medical professional can communicate information regarding a subject's screening of developing a developmental disorder to a subject or a subject's family. In some embodiments, a medical professional can provide a subject and/or a subject's family with information regarding a developmental disorder and risk assessment information, including treatment options, and referrals to specialists. In some embodiments, a medical professional can provide a copy of a subject's medical records to a specialist. In some embodiments, a research professional can apply information regarding a subject's risk of developing a developmental disorder to advance scientific research. In some embodiments, a research professional can obtain a subject's haplotype as described herein to evaluate a subject's enrollment, or continued participation, in a research study or clinical trial. In some embodiments, a research professional can communicate information regarding a subject's screening of a developmental disorder to a medical professional. In some embodiments, a research professional can refer a subject to a medical professional.

Any appropriate method can be used to communicate information to another person. For example, information can be given directly or indirectly to a professional and a laboratory technician can input a subject's genetic variation as described herein into a computer-based record. In some embodiments, information is communicated by making a physical alteration to medical or research records. For example, a medical professional can make a permanent notation or flag a medical record for communicating the risk assessment to other medical professionals reviewing the record. In addition, any type of communication can be used to communicate the risk assessment information. For example, mail, e-mail, telephone, and face-to-face interactions can be used. The information also can be communicated to a professional by making that information electronically available to the professional. For example, the information can be communicated to a professional by placing the information on a computer database such that the professional can access the information. In addition, the information can be communicated to a hospital, clinic, or research facility serving as an agent for the professional.

Results of these tests, and optionally interpretive information, can be returned to the subject, the health care provider or to a third party. The results can be communicated to the tested subject, for example, with a prognosis and optionally interpretive materials that can help the subject understand the test results and prognosis; used by a health care provider, for example, to determine whether to administer a specific drug, or whether a subject should be assigned to a specific category, for example, a category associated with a specific disease endophenotype, or with drug response or non-response; used by a third party such as a healthcare payer, for example, an insurance company or HMO, or other agency, to determine whether or not to reimburse a health care provider for services to the subject, or whether to approve the provision of services to the subject. For example, the healthcare payer can decide to reimburse a health care provider for treatments for a developmental disorder if the subject has a developmental disorder or has an increased risk of developing a developmental disorder.

Also provided herein are databases that include a list of genetic variations as described herein, and wherein the list can be largely or entirely limited to genetic variations identified as useful for screening a developmental disorder as described herein. The list can be stored, for example, on a flat file or computer-readable medium. The databases can further include information regarding one or more subjects, for example, whether a subject is affected or unaffected, clinical information such as endophenotype, age of onset of symptoms, any treatments administered and outcomes, for example, data relevant to pharmacogenomics, diagnostics, prognostics or theranostics, and other details, for example, data about the disorder in the subject, or environmental or other genetic factors. The databases can be used to detect correlations between a particular haplotype and the information regarding the subject.

The methods described herein can also include the generation of reports for use, for example, by a subject, care giver, or researcher, that include information regarding a subject's genetic variations, and optionally further information such as treatments administered, treatment history, medical history, predicted response, and actual response. The reports can be recorded in a tangible medium, e.g., a computer-readable disk, a solid state memory device, or an optical storage device.

Methods of Screening Using Variations in RNA and/or Polypeptides

In some embodiments of the disclosure, screening of a developmental disorder can be made by examining or comparing changes in expression, localization, binding partners, and composition of a polypeptide encoded by a nucleic acid associated with a developmental disorder, for example, in those instances where the genetic variations of the present disclosure results in a change in the composition or expression of the polypeptide and/or RNA, for example, mRNAs, microRNAs (miRNAs), and other noncoding RNAs (ncRNAs). Thus, screening of a developmental disorder can be made by examining expression and/or composition of one of these polypeptides and/or RNA, or another polypeptide and/or RNA encoded by a nucleic acid associated with a developmental disorder, in those instances where the genetic variation of the present disclosure results in a change in the expression, localization, binding partners, and/or composition of the polypeptide and/or RNA. In some embodiments, screening can comprise diagnosing a subject. In some embodiments, screening can comprise determining a prognosis of a subject, for example determining the susceptibility of developing a developmental disorder. In some embodiments, screening can comprise theranosing a subject.

The genetic variations described herein that show association to a developmental disorder can play a role through their effect on one or more of these nearby genes. For example, while not intending to be limited by theory, it is generally expected that a deletion of a chromosomal segment comprising a particular gene, or a fragment of a gene, can either result in an altered composition or expression, or both, of the encoded polypeptide and/or mRNA. Likewise, duplications, or high number copy number variations, are in general expected to result in increased expression of encoded polypeptide and/or RNA. Other possible mechanisms affecting genes within a genetic variation region include, for example, effects on transcription, effects on RNA splicing, alterations in relative amounts of alternative splice forms of mRNA, effects on RNA stability, effects on transport from the nucleus to cytoplasm, and effects on the efficiency and accuracy of translation. Thus, DNA variations can be detected directly, using the subjects unamplified or amplified genomic DNA, or indirectly, using RNA or DNA obtained from the subject's tissue(s) that are present in an aberrant form or expression level as a result of the genetic variations of the disclosure showing association to a developmental disorder (e.g., ASD). In another embodiment, DNA variations can be detected indirectly using a polypeptide or protein obtained from the subject's tissue(s) that is present in an aberrant form or expression level as a result of genetic variations of the disclosure showing association to the developmental disorder. In another embodiment, an aberrant form or expression level of a polypeptide or protein that results from one or more genetic variations of the disclosure showing association to the developmental disorder can be detected indirectly via another polypeptide or protein present in the same biological/cellular pathway that is modulated or interacts with said polypeptide or protein that results from one or more genetic variations of the disclosure. In some embodiments, the genetic variations of the disclosure showing association to a developmental disorder can affect the expression of a gene within the genetic variation region. In some embodiments, a genetic variation affecting an exonic region of a gene can affect, disrupt, or modulate the expression of the gene. In some embodiments, a genetic variation affecting an intergenic region of a gene can affect, disrupt, or modulate the expression of the gene.

Certain genetic variation regions can have flanking duplicated segments, and genes within such segments can have altered expression and/or composition as a result of such genomic alterations. Regulatory elements affecting gene expression can be located far away, even as far as tens or hundreds of kilobases away, from the gene that is regulated by said regulatory elements. Thus, in some embodiments, regulatory elements for genes that are located outside the genetic variation region can be located within the genetic variation, and thus be affected by the genetic variation. It is thus contemplated that the detection of the genetic variations described herein, can be used for assessing expression for one or more of associated genes not directly impacted by the genetic variations. In some embodiments, a genetic variation affecting an intergenic region of a gene can affect, disrupt, or modulate the expression of a gene located elsewhere in the genome, such as described above. For example, a genetic variation affecting an intergenic region of a gene can affect, disrupt, or modulate the expression of a transcription factor, located elsewhere in the genome, which regulates the gene.

In some embodiments, genetic variations of the disclosure showing association to ASD can affect protein expression at the translational level. It can be appreciated by those skilled in the art that this can occur by increased or decreased expression of one or more microRNAs (miRNAs) that regulates expression of a protein known to be important, or implicated, in the cause, onset, or progression of ASD. Increased or decreased expression of the one or more miRNAs can result from gain or loss of the whole miRNA gene, disruption or impairment of a portion of the gene (e.g., by an indel or CNV), or even a single base change (SNP or SNV) that produces an altered, non-functional or aberrant functioning miRNA sequence. It can also be appreciated by those skilled in the art that the expression of protein, for example, one known to cause ASD by increased or decreased expression, can result due to a genetic variation that results in alteration of an existing miRNA binding site within the polypeptide's mRNA transcript, or even creates a new miRNA binding site that leads to aberrant polypeptide expression.

A variety of methods can be used for detecting polypeptide composition and/or expression levels, including but not limited to enzyme linked immunosorbent assays (ELISA), Western blots, spectroscopy, mass spectrometry, peptide arrays, colorimetry, electrophoresis, isoelectric focusing, immunoprecipitations, immunoassays, and immunofluorescence and other methods well-known in the art. A test nucleic acid sample from a subject can be assessed for the presence of an alteration in the expression and/or an alteration in composition of the polypeptide encoded by a nucleic acid associated with a developmental disorder. An "alteration" in the polypeptide expression or composition, as used herein, refers to an alteration in expression or composition in a test nucleic acid sample, as compared to the expression or composition of the polypeptide in a control nucleic acid sample. Such alteration can, for example, be an alteration in the quantitative polypeptide expression or can be an alteration in the qualitative polypeptide expression, for example, expression of a mutant polypeptide or of a different splicing variant, or a combination thereof. In some embodiments, screening of a developmental disorder can be made by detecting a particular splicing variant encoded by a nucleic acid associated with a developmental disorder, or a particular pattern of splicing variants.

Antibodies can be polyclonal or monoclonal and can be labeled or unlabeled. An intact antibody or a fragment thereof can be used. The term "labeled", with regard to the probe or antibody, is intended to encompass direct labeling of the probe or antibody by coupling a detectable substance to the probe or antibody, as well as indirect labeling of the probe or antibody by reactivity with another reagent that is directly labeled as previously described herein. Other non-limiting examples of indirect labeling include detection of a primary antibody using a labeled secondary antibody, for example, a fluorescently-labeled secondary antibody and end-labeling of a DNA probe with biotin such that it can be detected with fluorescently-labeled streptavidin.

Detecting Genetic Variations Associated with Autism Spectrum Disorder

Described herein, are methods that can be used to detect genetic variations. Detecting specific genetic variations, for example polymorphic markers and/or haplotypes, copy number, absence or presence of an allele, or genotype associated with a developmental disorder as described herein, can be accomplished by methods known in the art for analyzing nucleic acids and/or detecting sequences at polymorphic or genetically variable sites, for example, amplification techniques, hybridization techniques, sequencing, arrays, or any combination thereof. Thus, by use of these methods disclosed herein or other methods available to the person skilled in the art, one or more alleles at polymorphic markers, including microsatellites, SNPs, SNVs, indels, CNVs, or other types of genetic variations, can be identified in a sample obtained from a subject.

Nucleic Acids

The nucleic acids and polypeptides described herein can be used in methods and kits of the present disclosure. In some embodiments, aptamers that specifically bind the nucleic acids and polypeptides described herein can be used in methods and kits of the present disclosure. As used herein, a nucleic acid can comprise a deoxyribonucleotide (DNA) or ribonucleotide (RNA), whether singular or in polymers, naturally occurring or non-naturally occurring, double-stranded or single-stranded, coding, for example a translated gene, or non-coding, for example a regulatory region, or any fragments, derivatives, mimetics or complements thereof. In some embodiments, nucleic acids can comprise oligonucleotides, nucleotides, polynucleotides, nucleic acid sequences, genomic sequences, complementary DNA (cDNA), antisense nucleic acids, DNA regions, probes, primers, genes, regulatory regions, introns, exons, open-reading frames, binding sites, target nucleic acids and allele-specific nucleic acids.

A "probe," as used herein, includes a nucleic acid fragment for examining a nucleic acid in a specimen using the hybridization reaction based on the complementarity of nucleic acid.

"A "hybrid" as used herein, includes a double strand formed between any one of the abovementioned nucleic acid, within the same type, or across different types, including DNA-DNA, DNA-RNA, RNA-RNA or the like.

"Isolated" nucleic acids, as used herein, are separated from nucleic acids that normally flank the gene or nucleotide sequence (as in genomic sequences) and/or has been completely or partially purified from other transcribed sequences (e.g., as in an RNA library). For example, isolated nucleic acids of the disclosure can be substantially isolated with respect to the complex cellular milieu in which it naturally occurs, or culture medium when produced by recombinant techniques, or chemical precursors or other chemicals when chemically synthesized. In some instances, the isolated material can form part of a composition, for example, a crude extract containing other substances, buffer system or reagent mix. In some embodiments, the material can be purified to essential homogeneity using methods known in the art, for example, by polyacrylamide gel electrophoresis (PAGE) or column chromatography (e.g., HPLC). With regard to genomic DNA (gDNA), the term "isolated" also can refer to nucleic acids that are separated from the chromosome with which the genomic DNA is naturally associated. For example, the isolated nucleic acid molecule can contain less than about 250 kb, 200 kb, 150 kb, 100 kb, 75 kb, 50 kb, 25 kb, 10 kb, 5 kb, 4 kb, 3 kb, 2 kb, 1 kb, 0.5 kb or 0.1 kb of the nucleotides that flank the nucleic acid molecule in the gDNA of the cell from which the nucleic acid molecule is derived.

Nucleic acids can be fused to other coding or regulatory sequences can be considered isolated. For example, recombinant DNA contained in a vector is included in the definition of "isolated" as used herein. In some embodiments, isolated nucleic acids can include recombinant DNA molecules in heterologous host cells or heterologous organisms, as well as partially or substantially purified DNA molecules in solution. Isolated nucleic acids also encompass in vivo and in vitro RNA transcripts of the DNA molecules of the present disclosure. An isolated nucleic acid molecule or nucleotide sequence can be synthesized chemically or by recombinant means. Such isolated nucleotide sequences can be useful, for example, in the manufacture of the encoded polypeptide, as probes for isolating homologous sequences (e.g., from other mammalian species), for gene mapping (e.g., by in situ hybridization with chromosomes), or for detecting expression of the gene, in tissue (e.g., human tissue), such as by Northern blot analysis or other hybridization techniques disclosed herein. The disclosure also pertains to nucleic acid sequences that hybridize under high stringency hybridization conditions, such as for selective hybridization, to a nucleotide sequence described herein Such nucleic acid sequences can be detected and/or isolated by allele- or sequence-specific hybridization (e.g., under high stringency conditions). Stringency conditions and methods for nucleic acid hybridizations are well known to the skilled person (see, e.g., Current Protocols in Molecular Biology, Ausubel, F. et al., John Wiley & Sons, (1998), and Kraus, M. and Aaronson, S., Methods Enzymol., 200:546-556 (1991), the entire teachings of which are incorporated by reference herein.

Calculations of "identity" or "percent identity" between two or more nucleotide or amino acid sequences can be determined by aligning the sequences for optimal comparison purposes (e.g., gaps can be introduced in the sequence of a first sequence). The nucleotides at corresponding positions are then compared, and the percent identity between the two sequences is a function of the number of identical positions shared by the sequences (i.e., % identity=# of identical positions/total # of positions×100). For example, a position in the first sequence is occupied by the same nucleotide as the corresponding position in the second sequence, then the molecules are identical at that position. The percent identity between the two sequences is a function of the number of identical positions shared by the sequences, taking into account the number of gaps, and the length of each gap, which need to be introduced for optimal alignment of the two sequences.

In some embodiments, the length of a sequence aligned for comparison purposes is at least 30%, at least 40%, at least 50%, at least 60%, at least 70%, at least 80%, at least 90%, or at least 95%, of the length of the reference sequence. The actual comparison of the two sequences can be accomplished by well-known methods, for example, using a mathematical algorithm. A non-limiting example of such a mathematical algorithm is described in Karlin, S. and Altschul, S., Proc. Natl. Acad. Sci. USA, 90-5873-5877 (1993). Such an algorithm is incorporated into the NBLAST and XBLAST programs (version 2.0), as described in Altschul, S. et al., Nucleic Acids Res., 25:3389-3402 (1997). When utilizing BLAST and Gapped BLAST programs, any relevant parameters of the respective programs (e.g., NBLAST) can be used. For example, parameters for sequence comparison can be set at score=100, word length=12, or can be varied (e.g., W=5 or W=20). Other examples include the algorithm of Myers and Miller, CABIOS (1989), ADVANCE, ADAM, BLAT, and FASTA. In some embodiments, the percent identity between two amino acid sequences can be accomplished using, for example, the GAP program in the GCG software package (Accelrys, Cambridge, UK).

"Probes" or "primers" can be oligonucleotides that hybridize in a base-specific manner to a complementary strand of a nucleic acid molecule. Probes can include primers, which can be a single-stranded oligonucleotide probe that can act as a point of initiation of template-directed DNA synthesis using methods including but not limited to, polymerase chain reaction (PCR) and ligase chain reaction (LCR) for amplification of a target sequence. Oligonucleotides, as described herein, can include segments or fragments of nucleic acid sequences, or their complements. In some embodiments, DNA segments can be between 5 and 10,000 contiguous bases, and can range from 5, 10, 12, 15, 20, or 25 nucleotides to 10, 15, 20, 25, 30, 40, 50, 100, 200, 500, 1000 or 10,000 nucleotides. In addition to DNA and RNA, probes and primers can include polypeptide nucleic acids (PNA), as described in Nielsen, P. et al., Science 254: 1497-1500 (1991). A probe or primer can comprise a region of nucleotide sequence that hybridizes to at least about 15, typically about 20-25, and in certain embodiments about 40, 50, 60 or 75, consecutive nucleotides of a nucleic acid molecule.

The present disclosure also provides isolated nucleic acids, for example, probes or primers, that contain a fragment or portion that can selectively hybridize to a nucleic acid that comprises, or consists of, a nucleotide sequence, wherein the nucleotide sequence can comprise at least one polymorphism or polymorphic allele contained in the genetic variations described herein or the wild-type nucleotide that is located at the same position, or the compliments thereof. In some embodiments, the probe or primer can be at least 70% identical, at least 80% identical, at least 85% identical, at least 90% identical, or at least 95% identical, to the contiguous nucleotide sequence or to the complement of the contiguous nucleotide sequence.

In some embodiments, a nucleic acid probe can be an oligonucleotide capable of hybridizing with a complementary region of a gene associated with a developmental disorder containing a genetic variation described herein. The nucleic acid fragments of the disclosure can be used as probes or primers in assays such as those described herein.

The nucleic acids of the disclosure, such as those described above, can be identified and isolated using standard molecular biology techniques well known to the skilled person. In some embodiments, DNA can be amplified and/or can be labeled (e.g., radiolabeled, fluorescently labeled) and used as a probe for screening, for example, a cDNA library derived from an organism. cDNA can be derived from mRNA and can be contained in a suitable vector. For example, corresponding clones can be isolated, DNA obtained fallowing in vivo excision, and the cloned insert can be sequenced in either or both orientations by art-recognized methods to identify the correct reading frame encoding a polypeptide of the appropriate molecular weight. Using these or similar methods, the polypeptide and the DNA encoding the polypeptide can be isolated, sequenced and further characterized.

In some embodiments, nucleic acid can comprise one or more polymorphisms, variations, or mutations, for example, single nucleotide polymorphisms (SNPs), single nucleotide variations (SNVs), copy number variations (CNVs), for example, insertions, deletions, inversions, and translocations. In some embodiments, nucleic acids can comprise analogs, for example, phosphorothioates, phosphoramidates, methyl phosphonate, chiralmethyl phosphonates, 2-0-methyl ribonucleotides, or modified nucleic acids, for example, modified backbone residues or linkages, or nucleic acids combined with carbohydrates, lipids, polypeptide or other materials, or peptide nucleic acids (PNAs), for example, chromatin, ribosomes, and transcriptosomes. In some embodiments nucleic acids can comprise nucleic acids in various structures, for example, A DNA, B DNA, Z-form DNA, siRNA, tRNA, and ribozymes. In some embodiments, the nucleic acid may be naturally or non-naturally polymorphic, for example, having one or more sequence differences, for example, additions, deletions and/or substitutions, as compared to a reference sequence. In some embodiments, a reference sequence can be based on publicly available information, for example, the U.C. Santa Cruz Human Genome Browser Gateway (genome.ucsc.edu/cgi-bin/hg-Gateway) or the NCBI website (www.ncbi.nlm.nih.gov). In some embodiments, a reference sequence can be determined by a practitioner of the present disclosure using methods well known in the art, for example, by sequencing a reference nucleic acid.

In some embodiment a probe can hybridize to an allele, SNP, or CNV as described herein. In some embodiments, the probe can bind to another marker sequence associated with a developmental disorder as described herein.

One of skill in the art would know how to design a probe so that sequence specific hybridization can occur only if a particular allele is present in a genomic sequence from a test nucleic acid sample. The disclosure can also be reduced to practice using any convenient genotyping method, including commercially available technologies and methods for genotyping particular genetic variations Control probes can also be used, for example, a probe that binds a less variable sequence, for example, a repetitive DNA associated with a centromere of a chromosome, can be used as a control. In some embodiments, probes can be obtained from commercial sources. In some embodiments, probes can be synthesized, for example, chemically or in vitro, or made from chromosomal or genomic DNA through standard techniques. In some embodiments sources of DNA that can be used include genomic DNA, cloned DNA sequences, somatic cell hybrids that contain one, or a part of one, human chromosome along with the normal chromosome complement of the host, and chromosomes purified by flow cytometry or microdissection. The region of interest can be isolated through cloning, or by site-specific amplification using PCR.

One or more nucleic acids for example, a probe or primer, can also be labeled, for example, by direct labeling, to comprise a detectable label. A detectable label can comprise any label capable of detection by a physical, chemical, or a biological process for example, a radioactive label, such as $^{32}$P or $^{3}$H, a fluorescent label, such as FITC, a chromophore label, an affinity-ligand label, an enzyme label, such as alkaline phosphatase, horseradish peroxidase, or 12 galactosidase, an enzyme cofactor label, a hapten conjugate label, such as digoxigenin or dinitrophenyl, a Raman signal generating label, a magnetic label, a spin label, an epitope label, such as the FLAG or HA epitope, a luminescent label, a heavy atom label, a nanoparticle label, electrochemical label, a light scattering label, a spherical shell label, semiconductor nanocrystal label, such as quantum dots (described in U.S. Pat. No. 6,207,392), and probes labeled with any other signal generating label known to those of skill in the art, wherein a label can allow the probe to be visualized with or without a secondary detection molecule. A nucleotide can be directly incorporated into a probe with standard techniques, for example, nick translation, random priming, and PCR labeling. A "signal," as used herein, include a signal suitably detectable and measurable by appropriate means, including fluorescence, radioactivity, chemiluminescence, and the like.

Non-limiting examples of label moieties useful for detection include, without limitation, suitable enzymes such as horseradish peroxidase, alkaline phosphatase, beta-galactosidase, or acetylcholinesterase; members of a binding pair that are capable of forming complexes such as streptavidini-biotin, avidin/biotin or an antigen/antibody complex including, for example, rabbit IgG and anti-rabbit IgG; fluorophores such as umbelliferone, fluorescein, fluorescein isothiocyanate, rhodamine, tetramethyl rhodamine, eosin, green fluorescent protein, erythrosin, coumarin, methyl coumarin, pyrene, malachite green, stilbene, lucifer yellow, Cascade Blue, Texas Red, dichlorotriazinylamine fluorescein, dansyl chloride, phycoerythrin, fluorescent lanthanide complexes such as those including Europium and Terbium, cyanine dye family members, such as Cy3 and Cy5, molecular beacons and fluorescent derivatives thereof, as well as others known in the art as described, for example, in Principles of Fluorescence Spectroscopy, Joseph R. Lakowicz (Editor), Plenum Pub Corp, 2nd edition (July 1999) and the 6th Edition of the Molecular Probes Handbook by Richard P. Hoagland; a luminescent material such as luminol; light scattering or plasmon resonant materials such as gold or silver particles or quantum dots; or radioactive material include $^{14}$C, $^{123}$I, $^{124}$I, $^{125}$I, Tc$^{99}$m, $^{32}$P, $^{33}$P, $^{35}$S or $^{3}$H.

Other labels can also be used in the methods of the present disclosure, for example, backbone labels. Backbone labels comprise nucleic acid stains that bind nucleic acids in a sequence independent manner. Non-limiting examples include intercalating dyes such as phenanthridines and acridines (e.g., ethidium bromide, propidium iodide, hexidium iodide, dihydroethidium, ethidium homodimer-1 and -2, ethidium monoazide, and ACMA); some minor grove binders such as indoles and imidazoles (e.g., Hoechst 33258, Hoechst 33342, Hoechst 34580 and DAPI); and miscellaneous nucleic acid stains such as acridine orange (also capable of intercalating), 7-AAD, actinomycin D, LDS751, and hydroxystilbamidine. All of the aforementioned nucleic acid stains are commercially available from suppliers such as Molecular Probes, Inc. Still other examples of nucleic acid stains include the following dyes from Molecular Probes: cyanine dyes such as SYTOX Blue, SYTOX Green, SYTOX Orange, POPO-1, POPO-3, YOYO-1, YOYO-3, TOTO-1, TOTO-3, JOJO-1, LOLO-1, BOBO-1, BOBO-3, PO-PRO-1, PO-PRO-3, BO-PRO-1, BO-PRO-3, TO-PRO- 1, TO-PRO-3, TO-PRO-5, JO-PRO-1, LO-PRO-1, YO-PRO-1, YO-PRO-3, PicoGreen, OliGreen, RiboGreen, SYBR Gold, SYBR Green I, SYBR Green II, SYBR DX, SYTO-40, −41, −42, −43, −44, −45 (blue), SYTO-13, −16, −24, −21, −23, −12, −11, −20, −22, −15, −14, −25 (green), SYTO-81, −80, −82, −83, −84, −85 (orange), SYTO-64, −17, −59, −61, −62, −60, −63 (red).

In some embodiments, fluorophores of different colors can be chosen, for example, 7-amino-4-methylcoumarin-3-acetic acid (AMCA), 5-(and-6)-carboxy-X-rhodamine, lissamine rhodamine B, 5-(and-6)-carboxyfluorescein, fluorescein-5-isothiocyanate (FITC), 7-diethylaminocoumarin-3-carboxylic acid, tetramethylrhodamine-5-(and-6)-isothiocyanate, 5-(and-6)-carboxytetramethylrhodamine, 7-hydroxycoumarin-3-carboxylic acid, 6-[fluorescein 5-(and-6)-carboxamido]hexanoic acid, N-(4,4-difluoro-5,7-dimethyl-4-bora-3a,4a diaza-3-indacenepropionic acid, eosin-5-isothiocyanate, erythrosin-5-isothiocyanate, TRITC, rhodamine, tetramethylrhodamine, R-phycoerythrin, Cy-3, Cy-5, Cy-7, Texas Red, Phar-Red, allophycocyanin (APC), and CASCADE™ blue acetylazide, such that each probe in or not in a set can be distinctly visualized. In some embodiments, fluorescently labeled probes can be viewed with a fluorescence microscope and an appropriate filter for each fluorophore, or by using dual or triple band-pass filter sets to observe multiple fluorophores. In some embodiments, techniques such as flow cytometry can be used to examine the hybridization pattern of the probes.

In other embodiments, the probes can be indirectly labeled, for example, with biotin or digoxygenin, or labeled with radioactive isotopes such as $^{32}P$ and/or $^{3}H$. As a non-limiting example, a probe indirectly labeled with biotin can be detected by avidin conjugated to a detectable marker. For example, avidin can be conjugated to an enzymatic marker such as alkaline phosphatase or horseradish peroxidase. In some embodiments, enzymatic markers can be detected using colorimetric reactions using a substrate and/or a catalyst for the enzyme. In some embodiments, catalysts for alkaline phosphatase can be used, for example, 5-bromo-4-chloro-3-indolylphosphate and nitro blue tetrazolium. In some embodiments, a catalyst can be used for horseradish peroxidase, for example, diaminobenzoate.

Methods of Detecting Genetic Variations

In some embodiments, standard techniques for genotyping for the presence genetic variations, for example, amplification, can be used. Amplification of nucleic acids can be accomplished using methods known in the art. Generally, sequence information from the region of interest can be used to design oligonucleotide primers that can be identical or similar in sequence to opposite strands of a template to be amplified. In some embodiments, amplification methods can include but are not limited to, fluorescence-based techniques utilizing PCR, for example, ligase chain reaction (LCR), Nested PCR, transcription amplification, self-sustained sequence replication, nucleic acid based sequence amplification (NASBA), and multiplex ligation-dependent probe amplification (MLPA). Guidelines for selecting primers for PCR amplification are well known in the art. In some embodiments, a computer program can be used to design primers, for example, Oligo (National Biosciences, Inc, Plymouth Minn.), MacVector (Kodak/IBI), and GCG suite of sequence analysis programs.

In some embodiments, commercial methodologies available for genotyping, for example, SNP genotyping, can be used, but are not limited to, TaqMan genotyping assays (Applied Biosystems), SNPlex platforms (Applied Biosystems), gel electrophoresis, capillary electrophoresis, size exclusion chromatography, mass spectrometry, for example, MassARRAY system (Sequenom), minisequencing methods, real-time Polymerase Chain Reaction (PCR), Bio-Plex system (BioRad), CEQ and SNPstream systems (Beckman), array hybridization technology, for example, Affymetrix GeneChip (Perlegen), BeadArray Technologies, for example, Illumina GoldenGate and Infinium assays, array tag technology, Multiplex Ligation-dependent Probe Amplification (MLPA), and endonuclease-based fluorescence hybridization technology (Invader; Third Wave). PCR can be a procedure in which target nucleic acid is amplified in a manner similar to that described in U.S. Pat. No. 4,683,195 and subsequent modifications of the procedure described therein. PCR can include a three phase temperature cycle of denaturation of DNA into single strands, annealing of primers to the denatured strands, and extension of the primers by a thermostable DNA polymerase enzyme. This cycle can be repeated so that there are enough copies to be detected and analyzed. In some embodiments, real-time quantitative PCR can be used to determine genetic variations, wherein quantitative PCR can permit both detection and quantification of a DNA sequence in a nucleic acid sample, for example, as an absolute number of copies or as a relative amount when normalized to DNA input or other normalizing genes. In some embodiments, methods of quantification can include the use of fluorescent dyes that can intercalate with double-stranded DNA, and modified DNA oligonucleotide probes that can fluoresce when hybridized with a complementary DNA.

In some embodiments of the disclosure, a nucleic acid sample obtained from the subject can be collected and PCR can used to amplify a fragment of nucleic acid that comprises one or more genetic variations that can be indicative of a susceptibility to a developmental disorder. In some embodiments, detection of genetic variations can be accomplished by expression analysis, for example, by using quantitative PCR. In some embodiments, this technique can assess the presence or absense of a genetic alteration in the expression or composition of one or more polypeptides or splicing variants encoded by a nucleic acid associated with a developmental disorder.

In some embodiments, the nucleic acid sample from a subject containing a SNP can be amplified by PCR prior to detection with a probe. In such an embodiment, the amplified DNA serves as the template for a detection probe and, in some embodiments, an enhancer probe. Certain embodiments of the detection probe, the enhancer probe, and/or the primers used for amplification of the template by PCR can comprise the use of modified bases, for example, modified A, T, C, G, and U, wherein the use of modified bases can be useful for adjusting the melting temperature of the nucleotide probe and/or primer to the template DNA, In some embodiments, modified bases are used in the design of the detection nucleotide probe. Any modified base known to the skilled person can be selected in these methods, and the selection of suitable bases is well within the scope of the skilled person based on the teachings herein and known bases available from commercial sources as known to the skilled person.

In some embodiments, identification of genetic variations can be accomplished using hybridization methods. The presence of a specific marker allele or a particular genomic segment comprising a genetic variation, or representative of a genetic variation, can be indicated by sequence-specific hybridization of a nucleic acid probe specific for the particular allele or the genetic variation in a nucleic acid sample that has or has not been amplified but methods described herein. The presence of more than one specific marker allele or several genetic variations can be indicated by using two or more sequence-specific nucleic acid probes, wherein each is specific for a particular allele and/or genetic variation.

Hybridization can be performed by methods well known to the person skilled in the art, for example, hybridization techniques such as fluorescent in situ hybridization (FISH), Southern analysis, Northern analysis, or in situ hybridization. In some embodiments, hybridization refers to specific hybridization, wherein hybridization can be performed with no mismatches. Specific hybridization, if present, can be using standard methods. In some embodiments, if specific hybridization occurs between a nucleic acid probe and the nucleic acid in the nucleic acid sample, the nucleic acid sample can contain a sequence that can be complementary to a nucleotide present in the nucleic acid probe. In some embodiments, if a nucleic acid probe can contain a particular allele of a polymorphic marker, or particular alleles for a plurality of markers, specific hybridization is indicative of the nucleic acid being completely complementary to the nucleic acid probe, including the particular alleles at polymorphic markers within the probe. In some embodiments a probe can contain more than one marker alleles of a particular haplotype, for example, a probe can contain alleles complementary to 2, 3, 4, 5 or all of the markers that make up a particular haplotype. In some embodiments detection of one or more particular markers of the haplotype in the nucleic acid sample is indicative that the source of the nucleic acid sample has the particular haplotype.

In some embodiments, PCR conditions and primers can be developed that amplify a product only when the variant allele is present or only when the wild type allele is present, for example, allele-specific PCR. In some embodiments of allele-specific PCR, a method utilizing a detection oligonucleotide probe comprising a fluorescent moiety or group at its 3' terminus and a quencher at its 5' terminus, and an enhancer oligonucleotide, can be employed, as described by Kutyavin et al. (Nucleic Acid Res. 34:e128 (2006)).

An allele-specific primer/probe can be an oligonucleotide that is specific for particular a polymorphism can be prepared using standard methods. In some embodiments, allele-specific oligonucleotide probes can specifically hybridize to a nucleic acid region that contains a genetic variation. In some embodiments, hybridization conditions can be selected such that a nucleic acid probe can specifically bind to the sequence of interest, for example, the variant nucleic acid sequence.

In some embodiments, allele-specific restriction digest analysis can be used to detect the existence of a polymorphic variant of a polymorphism, if alternate polymorphic variants of the polymorphism can result in the creation or elimination of a restriction site. Allele-specific restriction digests can be performed, for example, with the particular restriction enzyme that can differentiate the alleles. In some embodiments, PCR can be used to amplify a region comprising the polymorphic site, and restriction fragment length polymorphism analysis can be conducted. In some embodiments, for sequence variants that do not alter a common restriction site, mutagenic primers can be designed that can introduce one or more restriction sites when the variant allele is present or when the wild type allele is present.

In some embodiments, fluorescence polarization template-directed dye-terminator incorporation (FP-TDI) can be used to determine which of multiple polymorphic variants of a polymorphism can be present in a subject. Unlike the use of allele-specific probes or primers, this method can employ primers that can terminate adjacent to a polymorphic site, so that extension of the primer by a single nucleotide can result in incorporation of a nucleotide complementary to the polymorphic variant at the polymorphic site.

In some embodiments, DNA containing an amplified portion can be dot-blotted, using standard methods and the blot contacted with the oligonucleotide probe. The presence of specific hybridization of the probe to the DNA can then be detected. The methods can include determining the genotype of a subject with respect to both copies of the polymorphic site present in the genome, wherein if multiple polymorphic variants exist at a site, this can be appropriately indicated by specifying which variants are present in a subject. Any of the detection means described herein can be used to determine the genotype of a subject with respect to one or both copies of the polymorphism present in the subject's genome.

In some embodiments, a peptide nucleic acid (PNA) probe can be used in addition to, or instead of, a nucleic acid probe in the methods described herein. A PNA can be a DNA mimic having a peptide-like, inorganic backbone, for example, N-(2-aminoethyl) glycine units with an organic base (A, G, C, T or U) attached to the glycine nitrogen via a methylene carbonyl linker.

Nucleic acid sequence analysis can also be used to detect genetic variations, for example, genetic variations can be detected by sequencing exons, introns, 5' untranslated sequences, or 3' untranslated sequences. One or more methods of nucleic acid analysis that are available to those skilled in the art can be used to detect genetic variations, including but not limited to, direct manual sequencing, automated fluorescent sequencing, single-stranded conformation polymorphism assays (SSCP); clamped denaturing gel electrophoresis (CDGE); denaturing gradient gel electrophoresis (DGGE), two-dimensional gel electrophoresis (2DGE or TDGE); conformational sensitive gel electrophoresis (CSGE); denaturing high performance liquid chromatography (DHPLC), infrared matrix-assisted laser desorption/ionization (IR-MALDI) mass spectrometry, mobility shift analysis, quantitative real-time PCR, restriction enzyme analysis, heteroduplex analysis; chemical mismatch cleavage (CMC), RNase protection assays, use of polypeptides that recognize nucleotide mismatches, allele-specific PCR, real-time pyrophosphate DNA sequencing, PCR amplification in combination with denaturing high performance liquid chromatography (dHPLC), and combinations of such methods.

Sequencing can be accomplished through classic Sanger sequencing methods, which are known in the art. In some embodiments sequencing can be performed using high-throughput sequencing methods some of which allow detection of a sequenced nucleotide immediately after or upon its incorporation into a growing strand, for example, detection of sequence in substantially real time or real time. In some cases, high throughput sequencing generates at least 1,000, at least 5,000, at least 10,000, at least 20,000, at least 30,000, at least 40,000, at least 50,000, at least 100,000 or at least 500,000 sequence reads per hour; with each read being at least 50, at least 60, at least 70, at least 80, at least 90, at least 100, at least 120 or at least 150 bases per read (or 500-1,000 bases per read for 454).

High-throughput sequencing methods can include but are not limited to, Massively Parallel Signature Sequencing (MPSS, Lynx Therapeutics), Polony sequencing, 454 pyrosequencing, Illumina (Solexa) sequencing, SOLiD sequencing, on semiconductor sequencing, DNA nanoball sequencing, Helioscope™ single molecule sequencing, Single Molecule SMRT™ sequencing, Single Molecule real time (RNAP) sequencing, Nanopore DNA sequencing, and/or sequencing by hybridization, for example, a non-enzymatic method that uses a DNA microarray, or microfluidic Sanger sequencing.

In some embodiments, high-throughput sequencing can involve the use of technology available by Helicos BioSciences Corporation (Cambridge, Mass.) such as the Single Molecule Sequencing by Synthesis (SMSS) method. SMSS is unique because it allows for sequencing the entire human genome in up to 24 hours. This fast sequencing method also allows for detection of a SNP/nucleotide in a sequence in substantially real time or real time. Finally, SMSS is powerful because, like the MIP technology, it does not use a pre-amplification step prior to hybridization. SMSS does not use any amplification. SMSS is described in US Publication Application Nos. 20060024711; 20060024678; 20060012793; 20060012784; and 20050100932. In some embodiments, high-throughput sequencing involves the use of technology available by 454 Life Sciences, Inc. (a Roche company, Branford, Conn.) such as the PicoTiterPlate device which includes a fiber optic plate that transmits chemiluminescent signal generated by the sequencing reaction to be recorded by a CCD camera in the instrument. This use of fiber optics allows for the detection of a minimum of 20 million base pairs in 4.5 hours.

In some embodiments, PCR-amplified single-strand nucleic acid can be hybridized to a primer and incubated with a polymerase, ATP sulfurylase, luciferase, apyrase, and the substrates luciferin and adenosine 5' phosphosulfate. Next, deoxynucleotide triphosphates corresponding to the bases A, C, G, and T (U) can be added sequentially. A base incorporation can be accompanied by release of pyrophosphate, which can be converted to ATP by sulfurylase, which can drive synthesis of oxyluciferin and the release of visible light. Since pyrophosphate release can be equimolar with the number of incorporated bases, the light given off can be proportional to the number of nucleotides adding in any one step. The process can repeat until the entire sequence can be determined. In some embodiments, pyrosequencing can be utilized to analyze amplicons to determine whether breakpoints are present. In some embodiments, pyrosequencing can map surrounding sequences as an internal quality control.

Pyrosequencing analysis methods are known in the art. Sequence analysis can include a four-color sequencing by ligation scheme (degenerate ligation), which involves hybridizing an anchor primer to one of four positions. Then an enzymatic ligation reaction of the anchor primer to a population of degenerate nonamers that are labeled with fluorescent dyes can be performed. At any given cycle, the population of nonamers that is used can be structured such that the identity of one of its positions can be correlated with the identity of the fluorophore attached to that nonamer. To the extent that the ligase discriminates for complementarily at that queried position, the fluorescent signal can allow the inference of the identity of the base. After performing the ligation and four-color imaging, the anchor primer: nonamer complexes can be stripped and a new cycle begins. Methods to image sequence information after performing ligation are known in the art.

In some embodiments, analysis by restriction enzyme digestion can be used to detect a particular genetic variation if the genetic variation results in creation or elimination of one or more restriction sites relative to a reference sequence. In some embodiments, restriction fragment length polymorphism (RFLP) analysis can be conducted, wherein the digestion pattern of the relevant DNA fragment indicates the presence or absence of the particular genetic variation in the nucleic acid sample.

In some embodiments, arrays of oligonucleotide probes that can be complementary to target nucleic acid sequence segments from a subject can be used to identify genetic variations. In some embodiments, an array of oligonucleotide probes comprises an oligonucleotide array, for example, a microarray. In some embodiments, the present disclosure features arrays that include a substrate having a plurality of addressable areas, and methods of using them. At least one area of the plurality includes a nucleic acid probe that binds specifically to a sequence comprising a genetic variation, and can be used to detect the absence or presence of the genetic variation, for example, one or more SNPs, microsatellites, or CNVs, as described herein, to determine or identify an allele or genotype. For example, the array can include one or more nucleic acid probes that can be used to detect a genetic variation associated with a gene and/or gene product. In some embodiments, the array can further comprise at least one area that includes a nucleic acid probe that can be used to specifically detect another marker associated with a developmental disorder, for example Autism Spectrum Disorder, as described herein.

Microarray hybridization can be performed by hybridizing a nucleic acid of interest, for example, a nucleic acid encompassing a genetic variation, with the array and detecting hybridization using nucleic acid probes. In some embodiments, the nucleic acid of interest is amplified prior to hybridization. Hybridization and detecting can be carried out according to standard methods described in Published PCT Applications: WO 92/10092 and WO 95/11995, and U.S. Pat. No. 5,424,186. For example, an array can be scanned to determine the position on the array to which the nucleic acid hybridizes. The hybridization data obtained from the scan can be, for example, in the form of fluorescence intensities as a function of location on the array.

Arrays can be formed on substrates fabricated with materials such as paper; glass; plastic, for example, polypropylene, nylon, or polystyrene; polyacrylamide; nitrocellulose; silicon; optical fiber; or any other suitable solid or semisolid support; and can be configured in a planar, for example, glass plates or silicon chips); or three dimensional, for example, pins, fibers, beads, particles, microtiter wells, and capillaries, configuration.

Methods for generating arrays are known in the art and can include for example; photolithographic methods (U.S. Pat. Nos. 5,143,854, 5,510,270 and 5,527,681); mechanical methods, for example, directed-flow methods (U.S. Pat. No. 5,384,261); pin-based methods (U.S. Pat. No. 5,288,514); bead-based techniques (PCT US/93/04145); solid phase oligonucleotide synthesis methods; or by other methods known to a person skilled in the art (see, e.g., Bier, F. F., et al. Adv Biochem Eng Biotechnol 109:433-53 (2008); Hoheisel, J. D., Nat Rev Genet 7: 200-10 (2006); Fan, J. B., et al. Methods Enzymol 410:57-73 (2006); Raqoussis, J. & Elvidge, G., Expert Rev Mol Design 6: 145-52 (2006); Mockler, T. C., et al. Genomics 85: 1-15 (2005), and references cited therein, the entire teachings of each of which are incorporated by reference herein). Many additional descriptions of the preparation and use of oligonucleotide arrays for detection of polymorphisms can be found, for example, in U.S. Pat. No. 6,858,394, U.S. Pat. No. 6,429,027, U.S. Pat. No. 5,445,934, U.S. Pat. No. 5,700,637, U.S. Pat. No. 5,744,305, U.S. Pat. No. 5,945,334, U.S. Pat. No. 6,054,270, U.S. Pat. No. 6,300,063, U.S. Pat. No. 6,733,977, U.S. Pat. No. 7,364,858, EP 619 321, and EP 373

203, the entire teachings of which are incorporated by reference herein. Methods for array production, hybridization, and analysis are also described in Snijders et al., Nat. Genetics 29:263-264 (2001); Klein et al., Proc. Natl. Acad. Sci. USA 96:4494-4499 (1999); Albertson et al., Breast Cancer Research and Treatment 78:289-298 (2003); and Snijders et al., "BAC microarray based comparative genomic hybridization," in: Zhao et al. (eds), Bacterial Artificial Chromosomes: Methods and Protocols, Methods in Molecular Biology, Humana Press, 2002.

In some embodiments, oligonucleotide probes forming an array can be attached to a substrate by any number of techniques, including, but not limited to, in situ synthesis, for example, high-density oligonucleotide arrays, using photolithographic techniques; spotting/printing a medium to low density on glass, nylon, or nitrocellulose; by masking; and by dot-blotting on a nylon or nitrocellulose hybridization membrane. In some embodiments, oligonucleotides can be immobilized via a linker, including but not limited to, by covalent, ionic, or physical linkage. Linkers for immobilizing nucleic acids and polypeptides, including reversible or cleavable linkers, are known in the art (U.S. Pat. No. 5,451,683 and WO98/20019). In some embodiments, oligonucleotides can be non-covalently immobilized on a substrate by hybridization to anchors, by means of magnetic beads, or in a fluid phase, for example, in wells or capillaries.

An array can comprise oligonucleotide hybridization probes capable of specifically hybridizing to different genetic variations. In some embodiments, oligonucleotide arrays can comprise a plurality of different oligonucleotide probes coupled to a surface of a substrate in different known locations. In some embodiments, oligonucleotide probes can exhibit differential or selective binding to polymorphic sites, and can be readily designed by one of ordinary skill in the art, for example, an oligonucleotide that is perfectly complementary to a sequence that encompasses a polymorphic site, for example, a sequence that includes the polymorphic site, within it, or at one end, can hybridize preferentially to a nucleic acid comprising that sequence, as opposed to a nucleic acid comprising an alternate polymorphic variant.

In some embodiments, arrays can include multiple detection blocks, for example, multiple groups of probes designed for detection of particular polymorphisms. In some embodiments, these arrays can be used to analyze multiple different polymorphisms. In some embodiments, detection blocks can be grouped within a single array or in multiple, separate arrays, wherein varying conditions, for example, conditions optimized for particular polymorphisms, can be used during hybridization. General descriptions of using oligonucleotide arrays for detection of polymorphisms can be found, for example, in U.S. Pat. Nos. 5,858,659 and 5,837,832. In addition to oligonucleotide arrays, cDNA arrays can be used similarly in certain embodiments.

The methods described herein can include but are not limited to providing an array as described herein; contacting the array with a nucleic acid sample, and detecting binding of a nucleic acid from the nucleic acid sample to the array. In some embodiments, the method can comprise amplifying nucleic acid from the nucleic acid sample, for example, a region associated with a developmental disorder or a region that includes another region associated with a developmental disorder. In some embodiments, the methods described herein can include using an array that can identify differential expression patterns or copy numbers of one or more genes in nucleic acid samples from control and affected individuals. For example, arrays of probes to a marker described herein can be used to identify genetic variations between DNA from an affected subject, and control DNA obtained from an individual that does not have a developmental disorder. Since the nucleotides on the array can contain sequence tags, their positions on the array can be accurately known relative to the genomic sequence In some embodiments, it can be desirable to employ methods that can detect the presence of multiple genetic variations, for example, polymorphic variants at a plurality of polymorphic sites, in parallel or substantially simultaneously. In some embodiments, these methods can comprise oligonucleotide arrays and other methods, including methods in which reactions, for example, amplification and hybridization, can be performed in individual vessels, for example, within individual wells of a multi-well plate or other vessel.

Determining the identity of a genetic variation can also include or consist of reviewing a subject's medical history, where the medical history includes information regarding the identity, copy number, presence or absence of one or more alleles or SNPs in the subject, e.g., results of a genetic test.

In some embodiments extended runs of homozygosity (ROH) may be useful to map recessive disease genes in outbred populations. Furthermore, even in complex disorders, a high number of affected individuals may have the same haplotype in the region surrounding a disease mutation. Therefore, a rare pathogenic variant and surrounding haplotype can be enriched in frequency in a group of affected individuals compared with the haplotype frequency in a cohort of unaffected controls. Homozygous haplotypes (HH) that are shared by multiple affected individuals can be important for the discovery of recessive disease genes in complex disorders such as ASD. In some embodiments, the traditional homozygosity mapping method can be extended by analysing the haplotype within shared ROH regions to identify homozygous segments of identical haplotype that are present uniquely or at a higher frequency in ASD probands compared to parental controls. Such regions are termed risk homozygous haplotypes (rHH), which may contain low-frequency recessive variants that contribute to ASD risk in a subset of ASD patients.

Genetic variations can also be identified using any of a number of methods well known in the art. For example, genetic variations available in public databases, which can be searched using methods and custom algorithms or algorithms known in the art, can be used. In some embodiments, a reference sequence can be from, for example, the human draft genome sequence, publicly available in various databases, or a sequence deposited in a database such as GenBank.

Any of the polynucleotides described, including polynucleotides comprising a genetic variation, can be made synthetically using methods known in the art.

Methods of Detecting CNVs

Detection of genetic variations, specifically CNVs, can be accomplished by one or more suitable techniques described herein. Generally, techniques that can selectively determine whether a particular chromosomal segment is present or absent in an individual can be used for genotyping CNVs. Identification of novel copy number variations can be done by methods for assessing genomic copy number changes.

In some embodiments, methods include but are not limited to, methods that can quantitatively estimate the number of copies of a particular genomic segment, but can also include methods that indicate whether a particular segment is present in a nucleic acid sample or not. In some embodiments, the technique to be used can quantify the amount of segment present, for example, determining whether a DNA segment is deleted, duplicated, or triplicated in subject, for example, Fluorescent In Situ Hybridization (FISH) techniques, and other methods described herein. In some embodiments, methods include detection of copy number variation from array intensity and sequencing read depth using a stepwise Bayesian model (Zhang Z. D., et al. BMC Bioinformatics. 2010 Oct. 31; 11:539). In some embodiments, methods include detecting copy number variations using shotgun sequencing, CNV-seq (Xie C., et al. BMC Bioinformatics. 2009 Mar. 6; 10:80). In some embodiments, methods include analyzing next-generation sequencing (NGS) data for CNV detection using any one of several algorithms developed for each of the four broad methods for CNV detection using NGS, namely the depth of coverage (DOC), read-pair (RP), split-read (SR) and assembly-based (AS) methods. (Teo S. M., et al. Bioinformatics. 2012 Aug. 31). In some embodiments, methods include combining coverage with map information for the identification of deletions and duplications in targeted sequence data (Nord A. S., et al. BMC Genomics. 2011 Apr. 12; 12:184).

In some embodiments, other genotyping technologies can be used for detection of CNVs, including but not limited to, karyotype analysis, Molecular Inversion Probe array technology, for example, Affymetrix SNP Array 6.0, and BeadArray Technologies, for example, Illumina GoldenGate and Infinium assays, as can other platforms such as NimbleGen HD2.1 or HD4.2, High-Definition Comparative Genomic Hybridization (CGH) arrays (Agilent Technologies), tiling array technology (Affymetrix), multiplex ligation-dependent probe amplification (MLPA), Invader assay, fluorescence in situ hybridization, and, in one embodiment, Array Comparative Genomic Hybridization (aCGH) methods. As described herein, karyotype analysis can be a method to determine the content and structure of chromosomes in a nucleic acid sample. In some embodiments, karyotyping can be used, in lieu of aCGH, to detect translocations, which can be copy number neutral, and, therefore, not detectable by aCGH. Information about amplitude of particular probes, which can be representative of particular alleles, can provide quantitative dosage information for the particular allele, and by consequence, dosage information about the CNV in question, since the marker can be selected as a marker representative of the CNV and can be located within the CNV. In some embodiments, if the CNV is a deletion, the absence of particular marker allele is representative of the deletion. In some embodiments, if the CNV is a duplication or a higher order copy number variation, the signal intensity representative of the allele correlating with the CNV can represent the copy number. A summary of methodologies commonly used is provided in Perkel (Perkel J. Nature Methods 5:447-453 (2008)).

PCR assays can be utilized to detect CNVs and can provide an alternative to array analysis. In particular, PCR assays can enable detection of precise boundaries of gene/chromosome variants, at the molecular level, and which boundaries are identical in different individuals. PCR assays can be based on the amplification of a junction fragment present only in individuals that carry a deletion. This assay can convert the detection of a loss by array CGH to one of a gain by PCR.

Examples of PCR techniques that can be used in the present disclosure include, but are not limited to quantitative PCR, real-time quantitative PCR (qPCR), quantitative fluorescent PCR (QF-PCR), multiplex fluorescent PCR (MF-PCR), real time PCR (RT-PCR), single cell PCR, PCR-RFLP/RT-PCR-RFLP, hot start PCR and Nested PCR. Other suitable amplification methods include the ligase chain reaction (LCR), ligation mediated PCR (LM-PCR), degenerate oligonucleotide probe PCR (DOP-PCR), transcription amplification, self-sustained sequence replication, selective amplification of target polynucleotide sequences, consensus sequence primed polymerase chain reaction (CP-PCR), arbitrarily primed polymerase chain reaction (AP-PCR) and nucleic acid based sequence amplification (NABSA).

Alternative methods for the simultaneous interrogation of multiple regions include quantitative multiplex PCR of short fluorescent fragments (QMPSF), multiplex amplifiable probe hybridization (MAPH) and multiplex ligation-dependent probe amplification (MLPA), in which copy-number differences for up to 40 regions can be scored in one experiment. Another approach can be to specifically target regions that harbor known segmental duplications, which are often sites of copy-number variation. By targeting the variable nucleotides between two copies of a segmental duplication (called paralogous sequence variants) using a SNP-genotyping method that provides independent fluorescence intensities for the two alleles, it is possible to detect an increase in intensity of one allele compared with the other.

In some embodiments, the amplified piece of DNA can be bound to beads using the sequencing element of the nucleic acid tag under conditions that favor a single amplified piece of DNA molecule to bind a different bead and amplification occurs on each bead. In some embodiments, such amplification can occur by PCR. Each bead can be placed in a separate well, which can be a picoliter-sized well. In some embodiments, each bead is captured within a droplet of a PCR-reaction-mixture-in-oil-emulsion and PCR amplification occurs within each droplet. The amplification on the bead results in each bead carrying at least one million, at least 5 million, or at least 10 million copies of the single amplified piece of DNA molecule.

In embodiments where PCR occurs in oil-emulsion mixtures, the emulsion droplets are broken, the DNA is denatured and the beads carrying single-stranded nucleic acids clones are deposited into a well, such as a picoliter-sized well, for further analysis according to the methods described herein. These amplification methods allow for the analysis of genomic DNA regions. Methods for using bead amplification followed by fiber optics detection are described in Margulies et al. 2005, Nature. 15; 437(7057):376-80, and as well as in US Publication Application Nos. 20020012930; 20030068629; 20030100102; 20030148344; 20040248161; 20050079510, 20050124022; and 20060078909.

Another variation on the array-based approach can be to use the hybridization signal intensities that are obtained from the oligonucleotides employed on Affymetrix SNP arrays or in Illumina Bead Arrays. Here hybridization intensities are compared with average values that are derived from controls, such that deviations from these averages indicate a change in copy number. As well as providing information about copy number, SNP arrays have the added advantage of providing genotype information. For example, they can reveal loss of heterozygosity, which could provide supporting evidence for the presence of a deletion, or might indicate segmental uniparental disomy (which can recapitulate the effects of structural variation in some genomic regions—Prader-Willi and Angelman syndromes, for example).

Many of the basic procedures followed in microarray-based genome profiling are similar, if not identical, to those followed in expression profiling and SNP analysis, including the use of specialized microarray equipment and data-analysis tools. Since microarray-based expression profiling has been well established in the last decade, much can be learned from the technical advances made in this area. Examples of the use of microarrays in nucleic acid analysis that can be used are described in U.S. Pat. No. 6,300,063, U.S. Pat. No. 5,837,832, U.S. Pat. No. 6,969,589, U.S. Pat. No. 6,040,138, U.S. Pat. No. 6,858,412, U.S. application Ser. No. 08/529,115, U.S. application Ser. No. 10/272,384, U.S. application Ser. No. 10/045,575, U.S. application Ser. No. 10/264,571 and U.S. application Ser. No. 10/264,574. It should be noted that there are also distinct differences such as target and probe complexity, stability of DNA over RNA, the presence of repetitive DNA and the need to identify single copy number alterations in genome profiling.

In some embodiments, the genetic variations detected comprise CNVs and can be detected using array CGH. In some embodiments, array CGH can be been implemented using a wide variety of techniques. The initial approaches used arrays produced from large-insert genomic clones such as bacterial artificial chromosomes (BACs). Producing sufficient BAC DNA of adequate purity to make arrays is arduous, so several techniques to amplify small amounts of starting material have been employed. These techniques include ligation-mediated PCR (Snijders et al, Nat. Genet. 29:263-64), degenerate primer PCR using one or several sets of primers, and rolling circle amplification. BAC arrays that provide complete genome tiling paths are also available. Arrays made from less complex nucleic acids such as cDNAs, selected PCR products, and oligonucleotides can also be used. Although most CGH procedures employ hybridization with total genomic DNA, it is possible to use reduced complexity representations of the genome produced by PCR techniques. Computational analysis of the genome sequence can be used to design array elements complementary to the sequences contained in the representation. Various SNP genotyping platforms, some of which use reduced complexity genomic representations, can be useful for their ability to determine both DNA copy number and allelic content across the genome. In some embodiments, small amounts of genomic DNA can be amplified with a variety of whole genome or whole exome amplification methods prior to CGH analysis of the nucleic acid sample. A "whole exome," as used herein, includes s exons throughout the whole genome that are expressed in genes. Since exon selection has tissue and cell type specificity, these positions may be different in the various cell types resulting from a splice variant or alternative splicing. A "whole genome," as used herein, includes the entire genetic code of a genome.

The different basic approaches to array CGH provide different levels of performance, so some are more suitable for particular applications than others. The factors that determine performance include the magnitudes of the copy number changes, their genomic extents, the state and composition of the specimen, how much material is available for analysis, and how the results of the analysis can be used. Many applications use reliable detection of copy number changes of much less than 50%, a more stringent requirement than for other microarray technologies. Note that technical details are extremely important and different implementations of methods using the same array CGH approach can yield different levels of performance. Various CGH methods are known in the art and are equally applicable to one or more methods of the present disclosure. For example, CGH methods are disclosed in U.S. Pat. Nos. 7,030,231; 7,011,949; 7,014,997; 6,977,148; 6,951,761; and 6,916,621, the disclosure from each of which is incorporated by reference herein in its entirety.

The data provided by array CGH are quantitative measures of DNA sequence dosage. Array CGH provides high-resolution estimates of copy number aberrations, and can be performed efficiently on many nucleic acid samples. The advent of array CGH technology makes it possible to monitor DNA copy number changes on a genomic scale and many projects have been launched for studying the genome in specific diseases.

In some embodiments, whole genome array-based comparative genome hybridization (array CGH) analysis, or array CGH on a subset of genomic regions, can be used to efficiently interrogate human genomes for genomic imbalances at multiple loci within a single assay. The development of comparative genomic hybridization (CGH) (Kallioniemi et al, 1992, Science 258: 818-21) provided the first efficient approach to scanning entire genomes for variations in DNA copy number. The importance of normal copy number variation involving large segments of DNA has been unappreciated. Array CGH is a breakthrough technique in human genetics, which is attracting interest from clinicians working in fields as diverse as cancer and IVF (In Vitro Fertilization). The use of CGH microarrays in the clinic holds great promise for identifying regions of genomic imbalance associated with disease. Advances from identifying chromosomal critical regions associated with specific phenotypes to identifying the specific dosage sensitive genes can lead to therapeutic opportunities of benefit to patients. Array CGH is a specific, sensitive and rapid technique that can enable the screening of the whole genome in a single test. It can facilitate and accelerate the screening process in human genetics and is expected to have a profound impact on the screening and counseling of patients with genetic disorders. It is now possible to identify the exact location on the chromosome where an aberration has occurred and it is possible to map these changes directly onto the genomic sequence.

An array CGH approach provides a robust method for carrying out a genome-wide scan to find novel copy number variants (CNVs). The array CGH methods can use labeled fragments from a genome of interest, which can be competitively hybridized with a second differentially labeled genome to arrays that are spotted with cloned DNA fragments, revealing copy-number differences between the two genomes. Genomic clones (for example, BACs), cDNAs, PCR products and oligonucleotides, can all be used as array targets. The use of array CGH with BACs was one of the earliest employed methods and is popular, owing to the extensive coverage of the genome it provides, the availability of reliable mapping data and ready access to clones. The last of these factors is important both for the array experiments themselves, and for confirmatory FISH experiments.

In a typical CGH measurement, total genomic DNA is isolated from control and reference subjects, differentially labeled, and hybridized to a representation of the genome that allows the binding of sequences at different genomic locations to be distinguished. More than two genomes can be compared simultaneously with suitable labels. Hybridization of highly repetitive sequences is typically suppressed by the inclusion of unlabeled Cot-1 DNA in the reaction. In some embodiments of array CGH, it is beneficial to mechanically shear the genomic DNA in a nucleic acid sample, for example, with sonication, prior to its labeling and hybridization step. In another embodiment, array CGH may be performed without use of Cot-1 DNA or a sonication step in the preparation of the genomic DNA in a nucleic acid sample. The relative hybridization intensity of the test and reference signals at a given location can be proportional to the relative copy number of those sequences in the test and reference genomes. If the reference genome is normal then increases and decreases in signal intensity ratios directly indicate DNA copy number variation within the genome of the test cells. Data are typically normalized so that the modal ratio for the genome is set to some standard value, typically 1.0 on a linear scale or 0.0 on a logarithmic scale. Additional measurements such as FISH or flow cytometry can be used to determine the actual copy number associated with a ratio level.

In some embodiments, an array CGH procedure can include the following steps. First, large-insert clones, for example, BACs can be obtained from a supplier of clone libraries. Then, small amounts of clone DNA can be amplified, for example, by degenerate oligonucleotide-primed (DOP) PCR or ligation-mediated PCR in order to obtain sufficient quantities needed for spotting. Next, PCR products can be spotted onto glass slides using, for example, microarray robots equipped with high-precision printing pins. Depending on the number of clones to be spotted and the space available on the microarray slide, clones can either be spotted once per array or in replicate. Repeated spotting of the same clone on an array can increase precision of the measurements if the spot intensities are averaged, and allows for a detailed statistical analysis of the quality of the experiments. Subject and control DNAs can be labeled, for example, with either Cy3 or Cy5-dUTP using random priming and can be subsequently hybridized onto the microarray in a solution containing an excess of Cot1-DNA to block repetitive sequences. Hybridizations can either be performed manually under a coverslip, in a gasket with gentle rocking or, automatically using commercially available hybridization stations. These automated hybridization stations can allow for an active hybridization process, thereby improving the reproducibility as well as reducing the actual hybridization time, which increases throughput. The hybridized DNAs can detected through the two different fluorochromes using standard microarray scanning equipment with either a scanning confocal laser or a charge coupled device (CCD) camera-based reader, followed by spot identification using commercially or freely available software packages.

The use of CGH with arrays that comprise long oligonucleotides (60-100 bp) can improve the detection resolution (in some embodiments, as small as ~3-5 kb sized CNVs on arrays designed for interrogation of human whole genomes) over that achieved using BACs (limited to 50-100 kb or larger sized CNVs due to the large size of BAC clones). In some embodiments, the resolution of oligonucleotide CGH arrays is achieved via in situ synthesis of 1-2 million unique features/probes per microarray, which can include microarrays available from Roche NimbleGen and Agilent Technologies. In addition to array CGH methods for copy number detecton, other embodiments for partial or whole genome analysis of CNVs within a genome include, but are not limited to, use of SNP genotyping microarrays and sequencing methods.

Another method for copy number detection that uses oligonucleotides can be representational oligonucleotide microarray analysis (ROMA). It is similar to that applied in the use of BAC and CGH arrays, but to increase the signal-to-noise ratio, the 'complexity' of the input DNA is reduced by a method called representation or whole-genome sampling. Here the DNA that is to be hybridized to the array can be treated by restriction digestion and then ligated to adapters, which results in the PCR-based amplification of fragments in a specific size-range. As a result, the amplified DNA can make up a fraction of the entire genomic sequence—that is, it is a representation of the input DNA that has significantly reduced complexity, which can lead to a reduction in background noise. Other suitable methods available to the skilled person can also be used, and are within scope of the present disclosure.

A comparison of one or more genomes relative to one or more other genomes with array CGH, or a variety of other CNV detection methods, can reveal the set of CNVs between two genomes, between one genome in comparison to multiple genomes, or between one set of genomes in comparison to another set of genomes. In some embodiments, an array CGH experiment can be performed by hybrizing a single test genome against a pooled nucleic acid sample of two or more genomes, which can result in minimizing the detection of higher frequency variants in the experiment. In some embodiments, a test genome can be hybridized alone (i.e., one-color detetion) to a microarray, for example, using array CGH or SNP genotyping methods, and the comparison step to one or more reference genomes can be performed in silico to reveal the set of CNVs in the test genome relative to the one or more reference genomes. In one preferred embodiment, a single test genome is compared to a single reference genome in a 2-color experiment wherein both genomes are cohybridized to the microarray.

Array CGH can be used to identify genes that are causative or associated with a particular phenotype, condition, or disease by comparing the set of CNVs found in the affected cohort to the set of CNVs found in an unaffected cohort. An unaffected cohort may consist of any individual unaffected by the phenotype, condition, or disease of interest, but in one preferred embodiment is comprised of individuals or subjects that are apparently healthy (normal). Methods employed for such analyses are described in U.S. Pat. Nos. 7,702,468 and 7,957,913. In some embodiments of CNV comparison methods, candidate genes that are causative or associated (i.e., potentially serving as a biomarker) with a phenotype, condition, or disease will be identified by CNVs that occur in the affected cohort but not in the unaffected cohort. In some embodiments of CNV comparison methods, candidate genes that are causative or associated (i.e., potentially serving as a biomarker) with a phenotype, condition, or disease will be identified by CNVs that occur at a statistically significant higher frequency in the affected cohort as compared their frequency in the unaffected cohort. Thus, CNVs preferentially detected in the affected cohort as compared to the unaffected cohort can serve as beacons of genes that are causative or associated with a particular phenotype, condition, or disease. In some embodiments, CNV detection and comparison methods can result in direct identification of the gene that is causative or associated with phenotype, condition, or disease if the CNVs are found to overlap with or encompass the gene(s). In some embodiments, CNV detection and comparison methods can result in identification of regulatory regions of the genome (e.g., promoters, enhancers, transcription factor binding sites) that regulate the expression of one or more genes that are causative or associated with the phenotype, condition, or disease of interest.

Due to the large amount of genetic variation between any two genomes, or two sets (cohorts) of genomes, being compared, one preferred embodiment is to reduce the genetic variation search space by interrogating only CNVs, as opposed to the full set of genetic variants that can be identified in an individual's genome or exome. The set of CNVs that occur only, or at a statistically higher frequency, in the affected cohort as compared to the unaffected cohort can then be further investigated in targeted sequencing experiments to reveal the full set of genetic variants (of any size or type) that are causative or associated (i.e., potentially serving as a biomarker) with a phenotype, condition, or disease. It can be appreciated to those skilled in the art that the targeted sequencing experiments are performed in both the affected and unaffected cohorts in order to identify the genetic variants (e.g., SNVs and indels) that occur only, or at a statistically significant higher frequency, in the affected individual or cohort as compared to the unaffected cohort.

When investigating a particular phenotype, condition, or disease, such as ASD, it can be appreciated by those skilled in the art that the number of ASD candidate genes (or regulatory sequences) identified via CNV (or other variant types) detection methods may increase or decrease when additional ASD cohorts are analyzed. Similarly, the number of ASD candidate genes (or regulatory sequences), for example, identified via CNV (or other variant types) detection methods may increase or decrease when additional unaffected cohorts are used to interpret the affected cohort CNVs (or other variat types). For very rare CNVs (e.g., <0.1% frequency in the general population), only a single case may be observed in a given ASD cohort (e.g., 100 cases) but further statistical significance or evidence for the gene (or regulatory sequence/locus in the genome) can be established by: 1) CNV analysis of additional ASD cohorts, 2) CNV analysis of additional Normal cohorts, 3) targeted gene sequencing of both ASD and Normal cohorts, and/or 4) functional characterization of the ASD candidate gene (e.g., in silico analysis of the predicted impact of the candidate mutation on the gene product, RNAi knockdown experiments, biochemical assays on ASD patient tissue, gene expression analysis of disease-relevant tissues or of induced pluripotent stem cells (iPSCs) created from the ASD patient(s) harboring the candidate ASD-causing genetic variant).

A candidate gene may validate as causative of the phenotype, condition, or disease (e.g., ASD), which may, for example, be confirmed via mechansism of action experiments, or it may serve as a biomarker of the phenotype, condition, or disease. Thus, in the example of ASD, in some embodiments, the ASD-specific gene (or regulatory sequence/locus) may be a biomarker of age-of-onset for ASD and disease severity, and thus have diagnostic utility for monitoring patients known to be at risk for ASD or as a general screening test in the population for early diagnosis of the disease. In some embodiments, the ASD-specific gene/biomarker may be an indicator of drug response (e.g., a particular subtype of ASD may respond best to a therapeutic targeting a particular phenotype, causative gene, or other gene in the same pathway as the causative gene) and thus have utility during drug development in clinical trials. For example, clinical trials for a therapeutic that targets a ASD genetic subtype comprising only 10% of all patients exhibiting symptoms of ASD, can be designed to comprise only those 10% of patients with a specific genotype(s) in order to reduce the time and cost of such clinical trials (e.g., smaller number of patients in the clinical trial). It can be appreciated by those skilled in the art that such patient stratification methods (i.e., specific genotypes correlated with the disease or drug response) can be employed not only for targeted therapeutics, but in general for any drug that is approved or in development (i.e., the mechanism of action may or may not be known). For example, drugs in development or approved to treat, for example, cancer, may have utility in being repurposed to treat ASD. Such patient stratification methods can also be utilized to develop a companion diagnostic test (e.g., comprising the specific genes/genotypes found in patients that are indicative of drug response) for a particular drug, either concurrently during the clinical trials for the drug or after drug approval (e.g., as a new indication or for the physician to use in guiding medical decisions for the patient).

Further neurodevelopmental and/or links to ASD pathology can be established via pathway analysis of the genes, which may take into consideration binding interactions (e.g., via yeast 2-hybrid screen) and molecular events (e.g., kinase activity or other enzymatic processes) if such information is available for the gene(s) of interest (i.e., specified in the analysis). Both commercial (e.g., Ingenuity's IPA software and Thomson Reuter's GeneGo software) and open source software (e.g., String: string-db.org/) are available for such analyses. To assess connections to established ASD biology, analyses can be performed for the set of candidate ASD genes independently or against known causative ASD genes (e.g., FMR1, MECP2, and contactins such as CNTN4) singly or as a group. In some embodiments, ASD candidate genes can be distributed into one or more of several categories: 1) linked to a known causative ASD gene (e.g., binding partner) or a novel family member of a known ASD gene, 2) apoptosis pathway, 3) cell signaling (e.g., small GTPases, Wnt), 4) metabolism defects (e g, amino acids, purines/pyrimidines), mitochondrial dysfunction, 5) neuroprotective factors, 6) neurotransmitter signaling, 7) synapse formation/function, 8) ubiquitin/proteasome pathway, 9) neuropsychiatric genes, some of which are known drug targets, and 10) other (e.g., established role in other diseases with no obvious neurodevelopmental biology, such as cancer) or unknown gene function (e.g., limited or no gene information presently annotated for the ASD-specific gene).

A method of screening a subject for a disease or disorder can comprise assaying a nucleic acid sample from the subject to detect sequence information for more than one genetic locus and comparing the sequence information to a panel of nucleic acid biomarkers and screening the subject for the presence or absence of the disease or disorder if one or more of low frequency biomarkers in the panel are present in the sequence information.

The panel can comprise at least one nucleic acid biomarker for each of the more than one genetic loci. For example, the panel can comprise 2, 3, 4, 5, 6, 7, 8, 9, 10, 15, 20, 25, 30, 35, 40, 45, 50, 75, 100, 150, 200 or more nucleic acid biomarkers for each of the more than one genetic locus. In some embodiments, the panel can comprise from about 2-1000 nucleic acid biomarkers. For example, the panel can comprise from about 2-900, 2-800, 2-700, 2-600, 2-500, 2-400, 2-300, 2-200, 2-100, 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000 nucleic acid biomarkers.

The panel can comprise at least 2 low frequency biomarkers. For example, the panel can comprise at least 2, 3, 4, 5, 6, 7, 8, 9, 10, 11, 12, 3, 14, 15, 15, 17, 18, 19, 20, 25, 30, 35, 40, 45, 50, 55, 60, 65, 70, 75, 80, 85, 90, 95, 100, 125, 150, 175, 200, 250, 500, or 1000 or more low frequency biomarkers. In some embodiments, the panel can comprise from about 2-1000 low frequency biomarkers. For example, the panel can comprise from about 2-900, 2-800, 2-700, 2-600, 2-500, 2-400, 2-300, 2-200, 2-100, 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000 1000 low frequency biomarkers. In some embodiments, a low frequency biomarker can occur at a frequency of 0.1% or less in a population of subjects without a diagnosis of the disease or disorder. For example, a low frequency biomarker can occur at a frequency of 0.05%, 0.01%, 0.005%, 0.001%, 0.0005%, 0.0001%, 0.00005%, or 0.00001% or less in a population of subjects without a diagnosis of the disease or disorder. In some embodiments, a low frequency biomarker can occur at a frequency from about 0.00001%-0.1% in a population of subjects without a diagnosis of the disease or disorder. For example, a low frequency biomarker can occur at a frequency of from about 0.00001%-0.00005%, 0.00001%-0.0001%, 0.00001%-0.0005%, 0.00001%-0.001%, 0.00001%-0.005%, 0.00001%-0.01%, 0.00001%-0.05%, 0.00005%-0.0001%, 0.00005%-0.0005%, 0.00005%-0.001%, 0.00005%-0.005%, 0.00005%-0.01%, 0.00005%-0.05%, 0.00005%-0.1%, 0.0001%-0.0005%, 0.0001%-0.001%, 0.0001%-0.005%, 0.0001%-0.01%, 0.0001%-0.05%, 0.0001%-0.1%, 0.0005%-0.001%, 0.0005%-0.005%, 0.0005%-0.01%, 0.0005%-0.05%, 0.0005%-0.1%, 0.001%-0.005%, 0.001%-0.01%, 0.001%-0.05%, 0.001%-0.1%, 0.005%-0.01%, 0.005%-0.05%, 0.005%-0.1%, 0.01%-0.05%, 0.01%-0.1%, or 0.05%-0.1% in a population of subjects without a diagnosis of the disease or disorder In some embodiments, the presence or absence of the disease or disorder in the subject can be determined with at least 50% confidence. For example, the presence or absence of the disease or disorder in the subject can be determined with at least 50%, 55%, 60%, 65%, 70%, 75%, 80%, 85%, 90%, 95%, 98%, 99%, or 100% confidence. In some embodiments, the presence or absence of the disease or disorder in the subject can be determined with a 50%-100% confidence. For example, the presence or absence of the disease or disorder in the subject can be determined with a 60%-100%, 70%-100%, 80%-100%, 90%400%, 50%-90%, 50%-80%, 50%-70%, 50%-60%, 60%-90%, 60%-80%, 60%-70%, 70%-90%, 70%-80%, or 80%-90%. In one embodiement, ASD candidate CNVs and genes or regulatory loci associated with these CNVs can be determined or identified by comparing genetic data from a cohort of normal individuals to that of an individual or a cohort of individuals known to have, or be susceptible to a developmental disorder such as ASD.

In one embodiment, ASD candidate CNV-subregions and genes associated with these regions can be determined or identified by comparing genetic data from a cohort of normal individuals, such as a pre-existing database of CNVs found in normal individuals termed the Normal Variation Engine (NVE), to that of a cohort of individual known to have, or be susceptible to a developmental disorder such as ASD.

In some embodiments, a nucleic acid sample from one individual or nucleic acid samples from a pool of 2 or more individuals without ASD can serve as as the reference nucleic acid sample(s) and the nucleic acid sample from an individual known to have ASD or being tested to determine if they have ASD can serve as the test nucleic acid sample. In one preferred embodiment, the reference and test nucleic acid samples are sex-matched and co-hybridized on the CGH array. For example, reference nucleic acid samples can be labeled with a fluorophore such as Cy5, using methods described herein, and test subject nucleic acid samples can be labeled with a different fluorophore, such as Cy3. After labeling, nucleic acid samples can be combined and can be co-hybridized to a microarray and analyzed using any of the methods described herein, such as aCGH. Arrays can then be scanned and the data can be analyzed with software. Genetic alterations, such as CNVs, can be called using any of the methods described herein. A list of the genetic alterations, such as CNVs, can be generated for one or more test subjects and/or for one or more reference subjects. Such lists of CNVs can be used to generate a master list of non-redundant CNVs and/or CNV-subregions for each type of cohort. In one embodiment, a cohort of test nucleic acid samples, such as individuals known to have or suspected to have ASD, can be cohybridized with an identical sex-matched reference individual or sex-matched pool of reference individuals to generate a list of redundant or non-redutant CNVs. Such lists can be based on the presence or absence of one or more CNVs and/or CNV subregions present in individuals within the cohort. In this manner, a master list can contain a number of distinct CNVs and/or CNV-subregions, some of which are uniquely present in a single individual and some of which are present in multiple individuals.

In some embodiments, CNVs and/or CNV-subregions of interest can be obtained by annotation of each CNV and/or CNV-subregion with relevant information, such as overlap with known genes and/or exons exons or intergenic regulatory regions such as transcription factor binding sites. In some embodiments, CNVs and/or CNV-subregions of interest can be obtained by calculating the OR for a CNV and/or CNV-subregion according to the following formula: OR= (ASD/((# individuals in ASD cohort)−ASD))/(NVE/((# individuals in NVE cohort)−NVE)), where: ASD=number of ASD individuals with a CNV-subregion of interest and NVE=number of NVE subjects with the CNV-subregion of interest. If NVE=0, it can be set to 1 to avoid dealing with infinities in cases where no CNVs are seen in the NVE. In some embodiments, a set of publicly available CNVs (e.g., the Database of Genomic Variants) can be used as the Normal cohort for comparison to the affected cohort CNVs. In another embodiment, the set of Normal cohort CNVs may comprise a private database generated by the same CNV detection method, such as array CGH, or by a plurality of CNV detection methods that include, but are not limited to, array CGH, SNP genotyping arrays, custom CGH arrays, custom genotyping arrays, exome sequencing, whole genome sequencing, targeted sequencing, FISH, q-PCR, or MLPA.

The number of individuals in any given cohort can be at least about 10, 50, 100, 200, 300, 400, 500, 600, 700, 800, 900, 1000, 2500, 5000, 7500, 10,000, 100,000, or more. In some embodiments, the number of individuals in any given cohort can be from 25-900, 25-800, 25-700, 25-600, 25-500, 25-400, 25-300, 25-200, 25-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000.

In some embodiments, a method of determining relevance or statistical significance of a genetic variant in a human subject to a disease or a condition associated with a genotype comprising screening a genome of a human subject with the disease or condition, such as by array Comparative Genomic Hybridization, sequencing, or SNP genotyping, to provide information on one or more genetic variants, such as those in Tables 1 and 2. The method can further comprise comparing, such as via a computer, information of said one or more genetic variants from the genome of said subject to a compilation of data comprising frequencies of genetic variants in at least 100 normal human subjects, such as those without the disease or condition. The method can further comprise determining a statistical significance or relevance of said one or more genetic variants from said comparison to the condition or disease or determining whether a genetic variant is present in said human subject but not present in said compilation of data from said comparison, or an algorithm can be used to call or identify significant genetic variations, such as a genetic variation whose median log 2 ratio is above or below a computed value. A computer can comprise computer executable logic that provides instructions for executing said comparison.

Different categories for CNVs of interest can be defined. In some embodiments, CNVs/CNV-subregions can be of interest if the CNVs/CNV-subregions do not overlap (distinct CNV/CNV-subregion), but impact the same gene (or regulatory locus) and are associated with an OR of greater than 6 (Genic (distinct CNV-subregions); OR>6). For example, CNVs/CNV-subregions can be of interest if the CNVs/CNV-subregions do not overlap, but impact the same gene (or regulatory locus), and are associated with an OR of at least 7, 8, 9, 10, 12, 14, 16, 18, 20, 25, 30, 35, 40, 45, 50, or more. In some embodiments, CNVs/CNV-subregions can be of interest if the CNVs/CNV-subregions do not overlap, but impact the same gene (or regulatory locus), and are associated with an OR from about 6-100, 6-50, 6-40, 6-30, 6-20, 6-10, 6-9, 6-8, 6-7, 8-100, 8-50, 8-40, 8-30, 8-20, 8-10, 10-100, 10-50, 10-40, 10-30, 10-20, 20-100, 20-50, 20-40, 20-30, 30-100, 30-50, 30-40, 40-100, 40-50, 50-100, or 5-7. The CNV-subregion/gene can be an exonic or intronic part of the gene, or both.

In some embodiments, CNVs/CNV-subregions can be of interest if the CNVs/CNV-subregions do not overlap a known gene (e.g., are non-genic or intergenic) and they are associated with an OR of at least 7 (Exon+ve, ASD>4, NVE<2, no Sanger filter applied). For example, CNVs/CNV-subregions can be of interest if the CNVs/CNV-subregion does not overlap a known gene (e.g., is non-genic or intergenic) and/or non-overlapping, impact an exon, affect 5 or more ASD cases but only 0 or 1 Normal subjects, no Sanger filter of CNVs is applied, and are associated with an OR of at least 8, 9, 10, 11, 12, 14, 16, 18, 20, 25, 30, 35, 40, 45, 50, or more. In some embodiments, CNVs/CNV-subregions can be of interest if the CNVs/CNV-subregions are overlapping and/or non-overlapping, impact an exon, affect 5 or more ASD cases but only 0 or 1 Normal subjects, no filter of Sanger CNVs is applied, and are associated with an OR from about 7-100, 7-50, 7-40, 7-30, 7-20, 20-100, 20-50, 20-40, 20-30, 30-100, 30-50, 30-40, 40-100, 40-50, 50-100, or 7-11.

In some embodiments, CNVs/CNV-subregions can be of interest if the CNVs/CNV-subregions are overlapping and/or non-overlapping, impact an exon, and they affect <5 ASD cases but only 0 or 1 Normal subjects, a Sanger filter is applied, and there are no Sanger CNVs that overlap (Exon+ve, 5>ASD>1, Normals<2, Sanger filter−ve). This can enable identification of rarer CNVs in cases with a neurodevelopmental disorder but with the stringency of Sanger CNVs that are presumed to be relatively common in the general population. In some embodiments, CNVs/CNV-subregions can be of interest if the CNVs/CNV-subregions are overlapping and/or non-overlapping, impact an exon, and they affect 1 ASD cases but only 0 or 1 Normal subjects, a Sanger filter is applied, there are no Sanger CNVs that overlap, and are associated with an OR greater than 1, such as 1.47, or from 1-2.5. In some embodiments, CNVs/CNV-subregions can be of interest if the CNVs/CNV-subregions are overlapping and/or non-overlapping, impact an exon, and they affect 2 ASD cases but only 0 or 1 Normal subjects, a Sanger filter is applied, there are no Sanger CNVs that overlap, and are associated with an OR greater than 2.5, such as 2.95, or from 2.5-4. In some embodiments, CNVs/CNV-subregions can be of interest if the CNVs/CNV-subregions are overlapping and/or non-overlapping, impact an exon, and they affect 3 ASD cases but only 0 or 1 Normal subjects, a Sanger filter is applied, there are no Sanger CNVs that overlap, and are associated with an OR greater than 4, such as 4.44, or from 4-5.5. In some embodiments, CNVs/CNV-subregions can be of interest if the CNVs/CNV-subregions are overlapping and/or non-overlapping, impact an exon, and they affect 4 ASD cases but only 0 or 1 Normal subjects, a Sanger filter is applied, there are no Sanger CNVs that overlap, and are associated with an OR greater than 5.5, such as 5.92, or from 5.5-6.8

In some embodiments, a CNVs/CNV-subregions can be of interest if the OR associated with the sum of ASD cases and the sum of NVE subjects affecting the same gene (including distinct CNVs/CNV-subregions) is at least 6. For example, a CNV/CNV-subregion can be of interest if the OR associated with the sum of ASD cases and the sum of NVE subjects affecting the same gene (including distinct CNVs/CNV-subregions) is at least 7, 8, 9, 10, 12, 14, 16, 18, 20, 25, 30, 35, 40, 45, 50, or more. In some embodiments, a CNVs/CNV-subregions can be of interest if the OR associated with the sum of ASD cases and the sum of NVE subjects affecting the same gene (including distinct CNVs/CNV-subregions) is from about 6-100, 6-50, 6-40, 6-30, 6-20, 6-10, 6-9, 6-8, 6-7, 8-100, 8-50. 8-40, 8-30, 8-20, 8-10, 10-100, 10-50, 10-40, 10-30, 10-20, 20-100, 20-50, 20-40, 20-30, 30-100, 30-50, 30-40, 40-100, 40-50, 50-100, or 5-7.

In some embodiments, CNVs/CNV-subregions can be of interest if the CNVs/CNV-subregions impact an intron and they affect 5 or more ASD cases but only 0 or 1 Normal subjects, no Sanger filter of CNVs is applied, and they are associated with an OR of at least 7 (Intron+ve, ASD>4, Normals<2, no Sanger filter applied). For example, CNVs/CNV-subregions can be of interest if the CNVs/CNV-subregions impact an intron and they affect 5 or more ASD cases but only 0 or 1 Normal subjects, no Sanger filter of CNVs is applied, and they are associated with an OR of at least 8, 9, 10, 11, 12, 14, 16, 18, 20, 25, 30, 35, 40, 45, 50, or more. In some embodiments, CNVs/CNV-subregions can be of interest if the CNVs/CNV-subregions impact an intron and they affect 5 or more ASD cases but only 0 or 1 Normal subjects, no Sanger filter of CNVs is applied, and they are associated with an OR from about 7-100, 7-50, 7-40, 7-30, 7-20, 20-100, 20-50, 20-40, 20-30, 30-100, 30-50, 30-40, 40-100, 40-50, 50-100, or 7-11. CNVs/CNV-subregions impacting introns can be pathogenic (e.g., such variants can result in alternatively spliced mRNAs or loss of a micro-RNA binding site, which may deleteriously impact the resulting protein's structure or expression level).

In some embodiments, CNVs/CNV-subregions can be of interest if the CNVs/CNV-subregions impact the MTRNR2L (also known as humanin) gene family (MTRNR2L_family). While humanins may have neuroprotective properties for Alzheimer's disease, it is not established in neurodevelopment disorders; however, recently links have been established between the Alzheimer's gene APP and neurodevelopmental disorders such as autism (Westmark C J. What's hAPPening at synapses? The role of amyloid β-protein precursor and β-amyloid in neurological disorders. Mol Psychiatry. 2012 Aug. 28). In some embodiments, a rare CNV of less than 0.2% frequency in a neurodevelopmental cohort can be of interest. For example, 1 ASD case may contain a CNV impacting a humanin gene family member and this same CNV may not be found in a Normal subject or in only 1 Normal subject such that the OR is 1.47. In another embodiment, the OR may be close to 1, such as 0.98, but with screening of larger cohorts of Normal subjects and ASD cases (or other neurodevelopmental cohort) for both CNVs and any other type of genetic variant, such as SNVs via sequencing, it may be found that deleterious mutations in a humanin gene occur at higher frequency in neurodevelopmental cases than in Normal subjects. In some embodiments CNVs/CNV-subregions can be of interest if the CNVs/CNV-subregions impact the MTRNR2L1 gene and they affect 4 ASD cases but only 0 or 1 Normal subjects and are associated with an OR greater than 5.5, such as greater than 6, 7, 8, 9, 10, 11, 12, 14, 16, 18, 20, 25, 30, 35, 40, 45, 50, or more, or 5.92. In some embodiments CNVs/CNV-subregions can be of interest if the CNVs/CNV-subregions impact the MTRNR2L1 gene and they affect 4 ASD cases but only 0 or 1 Normal subjects and are associated with an OR from about 5.5-6.8 In some embodiments CNVs/CNV-subregions can be of interest if the CNVs/CNV-subregions impact the MTRNR2L4 gene and they affect 1 ASD case but only 0 or 1 Normal subjects and are associated with an OR greater than 1, such greater than 2, 3, 4, 5, 6, 7, 8, 9, 10, 11, 12, 14, 16, 18, 20, 25, 30, 35, 40, 45, 50, or more, or 1.47. In some embodiments CNVs/CNV-subregions can be of interest if the CNVs/CNV-subregions impact the MTRNR2L4 gene and they affect 1 ASD case but only 0 or 1 Normal subjects and are associated with an OR from about 1-2.5. In some embodiments CNVs/CNV-subregions can be of interest if the CNVs/CNV-subregions impact the MTRNR2L5 gene and they affect 2 ASD cases but only 3 Normal subjects and are associated with an OR greater than 0.5, such as greater than 1, 2, 3, 4, 5, 6, 7, 8, 9, 10, 11, 12, 14, 16, 18, 20, 25, 30, 35, 40, 45, 50, or more, or 0.98. In some embodiments CNVs/CNV-subregions can be of interest if the CNVs/CNV-subregions impact the MTRNR2L5 gene and they affect 2 ASD cases but only 3 Normal subjects and are associated with an OR from about 0.5-1. In some embodiments CNVs/CNV-subregions can be of interest if the CNVs/CNV-subregions impact the MTRNR2L8 gene and they affect 1 ASD cases but only 0 or 1 Normal subjects and are associated with an OR greater than 1, such as greater than 2, 3, 4, 5, 6, 7, 8, 9, 10, 11, 12, 14, 16, 18, 20, 25, 30, 35, 40, 45, 50, or more, or 1.47. In some embodiments CNVs/CNV-subregions can be of interest if the CNVs/CNV-subregions impact the MTRNR2L8 gene and they affect 1 ASD cases but only 0 or 1 Normal subjects and are associated with an OR from about 1-2.5.

In some embodiments, CNVs/CNV-subregions can be of interest if the CNVs/CNV-subregions occur within intergenic regions and are associated with an OR of greater than 30 (High OR intergenic (OR>30)). For example, CNVs/CNV-subregions can be of interest if the CNVs/CNV-subregions occur within intergenic regions and are associated with an OR of greater than 31, 32, 33, 34, 35, 40, 45, 50, 66, 60, 65, 70, 75, 80, 85, 90, 95, 100 or more. In some embodiments, CNVs/CNV-subregions can be of interest if the CNVs/CNV-subregions impact occur within intergenic regions and are associated with an OR from about 30-100, 30-90, 30-80, 30-70, 30-60, 30-50, 30-40, 40-100, 40-90, 40-80, 40-70, 40-60, 40-50, 50-100, 50-90, 50-80, 50-70, 50-60, 60-100, 60-90, 60-80, 60-70, 70-100, 70-90, 70-80, 80-100, 80-90, or 90-100.

In some embodiments, a CNV/CNV-subregion can be of interest if the CNV/CNV-subregion overlaps a known gene, and is associated with an OR of at least 10. In some embodiments, a CNV/CNV-subregion can be of interest if the CNV/CNV-subregion overlaps a known gene, is associated with an OR of at least 6, and if the OR associated with the sum of ASD cases and the sum of NVE subjects affecting the same gene (including distinct CNV-subregions) is at least 6.

The data presented in Tables 1-4 was generated on the basis of a comparison of copy number variants (CNVs) identified in a NVE and an ASD cohort. CNV genome locations are provided using the Human March 2006 (NCBI36/hg18) assembly. It can be appreciated by those skilled in the art that a CNV found in an affected individual may have one or more subregions that are preferentially found in the affected cohort as compared to the unaffected cohort and, similarly, other subregions within the CNV that are found at comparable frequencies, or not statistically significant different frequencies, in the affected and unaffected cohorts. In a preferred embodiment, CNV detection and analysis methods are employed that enable comparison of CNV subregions to facilitate identification of genes (or regulatory loci) that are causative or associated with the phenotype, condition, or disease being investigated (or detected for diagnostic purposes)

Table 1 lists all CNVs (SEQ ID NOs: 1-883) of interest, obtained as described in the text, with the exception that, for each entry, the chromosome (Chr) and original CNV start and stop positions are listed, along with original CNV size, type (loss or gain), ASD case ID, gene symbols (for the CNV-subregion, not the original CNV), Odds Ratio (OR) that is relevant to the CNV-subregion and, finally, the category of interest. The gene symbols refer to annotations for genes within the CNV-subregion, not the original CNV. In addition, the column 'SEQ ID No' lists the SEQ IDs of the sequences being submitted. Note that for some CNVs that are identical between different individuals, the priority numbers (and SEQ IDs) are identical. In other words, the sequence for a given CNV is only included once, if identical in different individuals. For example, 2 rows of Table 1 may refer to identical CNVs in 2 ASD cases.

Table 2 is identical to Table 1, with 4 exceptions. The CNV coordinates listed refer to the actual CNV-subregions found to be unique or significantly different between the ASD and NVE cohorts, as opposed to Table 1, which lists the original CNVs. In addition, an extra column details whether genic CNV-subregions of interest overlap an exon or not (Exon Overlap, Y=yes, N=N). 2 extra columns detail the number of NVE subjects (NVE) and the number of ASD cases (ASD) that harbor the relevant CNV-subregion.

Table 3 represents a non-redundant list for all genes listed in Table 2 (namely, those relevant to CNV-subregions of interest), and includes the Gene name (RefSeq Gene Symbol), Exon overlap (Y=yes, N=no), NCBI Gene ID (DNA Accession number), Gene Description (brief gene description), and RefSeq Summary (summary of gene function).

Table 4 represents a non-redundant list for all genes listed in Table 2 (namely, those relevant to CNV-subregions of interest) and includes RefSeq Gene Symbol, Exon overlap (intronic, exonic or both, SEQ ID No (consecutive SEQ ID numbers from Table 1). SEQ ID NOs: 884-1690 refer to the transcript sequences; RefSeq Accession Number (may be multiple entries per gene, hence Table 4 has more entries than Table 3); mRNA_ Description (brief description of mRNA), and RefSeq Summmary (summary of gene function). For CNVs that encompass consecutive introns and exons, there may be multiple features reported per CNV.

More than one RNA product (e.g., alternatively spliced mRNA transcripts and non-coding RNAs) can be produced from a single gene. Table 4 lists all presently known transcript variants (and their RNA accession numbers) but new variants may be found when further studies are completed and that generation of these additional transcript variants (and ultimately polypeptide and/or regulatory RNA products) may also be impacted by one or more CNVs or CNV subregions listed in Tables 1 and 2, respectively. The transcripts listed in Table 4 can be expression products of the same gene biomarker. The gene biomarker can comprise genomic DNA encoding the gene, including exons, introns, and/or regulatory binding regions (such as enhancers, promoters, silencers, and/or response elements). Point mutations, polymorphisms, single nucleotide polymorphisms (SNPs), single nucleotide variations (SNVs), translocations, insertions, deletions, amplifications, inversions, microsatellites, interstitial deletions, CNVs, loss of heterozygosity, or any other aberrations which affect the structure or function of one or more gene biomarkers and/or expression products thereof, can be associated with a neurodevelopmental disorder as described herein.

Table 5 represents a key showing the relationship of the chromosome number in coumn 1 of Table 1 and Table 2 and the actual chromosome where the CNVs/CNV-subregions were detected.

In some embodiments, the CNVs from Table 1 only include the CNVs in Table 1 of U.S. Provisional Application No. 61/744,463.

In some embodiments, the CNV subregions from Table 2 only include the CNV subregions in Table 2 of U.S. Provisional Application No. 61/744,463.

In some embodiments, the genes from Table 3 only include the genes in Table 3 of U.S. Provisional Application No. 61/744,463.

In some embodiments, the transcripts from Table 4 only include the transcripts in Table 4 of U.S. Provisional Application No. 61/744,463.

TABLE 1

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 1 | 554287 | 773763 | 219476 | loss | 1229 | LOC643837, NCRNA00115 | 8.91 | Exon + ve, ASD > 4, Normals < 2, no Sanger filter applied | 439 |
| 1 | 554287 | 839166 | 284879 | gain | 1252 | LOC643837, NCRNA00115 | 8.91 | Exon + ve, ASD > 4, Normals < 2, no Sanger filter applied | 440 |
| 1 | 554287 | 842726 | 288439 | gain | 1742 | LOC643837, NCRNA00115 | 8.91 | Exon + ve, ASD > 4, Normals < 2, no Sanger filter applied | 441 |
| 1 | 554287 | 893629 | 339342 | gain | 1811 | LOC643837, NCRNA00115 | 8.91 | Exon + ve, ASD > 4, Normals < 2, no Sanger filter applied | 442 |
| 1 | 554287 | 839166 | 284879 | gain | 1837 | LOC643837, NCRNA00115 | 8.91 | Exon + ve, ASD > 4, Normals < 2, no Sanger filter applied | 440 |
| 1 | 554287 | 839166 | 284879 | gain | 1900 | LOC643837, NCRNA00115 | 8.91 | Exon + ve, ASD > 4, Normals < 2, no Sanger filter applied | 440 |
| 1 | 554287 | 842726 | 288439 | gain | 1252 | LOC643837 | 7.42 | Exon + ve, ASD > 4, Normals < 2, no Sanger filter applied | 441 |
| 1 | 554287 | 842726 | 288439 | gain | 1742 | LOC643837 | 7.42 | Exon + ve, ASD > 4, Normals < 2, no Sanger filter applied | 441 |
| 1 | 554287 | 893629 | 339342 | gain | 1811 | LOC643837 | 7.42 | Exon + ve, ASD > 4, Normals < 2, no Sanger filter applied | 442 |
| 1 | 554287 | 839166 | 284879 | gain | 1837 | LOC643837 | 7.42 | Exon + ve, ASD > 4, Normals < 2, no Sanger filter applied | 440 |
| 1 | 554287 | 839166 | 284879 | gain | 1900 | LOC643837 | 7.42 | Exon + ve, ASD > 4, Normals < 2, no Sanger filter applied | 440 |
| 1 | 9769722 | 9776903 | 7181 | loss | 1301 | CLSTN1 | 21.04 | Intron + ve, ASD > 4, Normals < 2, no Sanger filter applied | 8 |
| 1 | 9769722 | 9776903 | 7181 | loss | 1474 | CLSTN1 | 21.04 | Intron + ve, ASD > 4, Normals < 2, no Sanger filter applied | 8 |
| 1 | 9769722 | 9776903 | 7181 | loss | 1487 | CLSTN1 | 21.04 | Intron + ve, ASD > 4, Normals < 2, no Sanger filter applied | 8 |
| 1 | 9769722 | 9776903 | 7181 | loss | 1533 | CLSTN1 | 21.04 | Intron + ve, ASD > 4, Normals < 2, no Sanger filter applied | 8 |
| 1 | 9769722 | 9776903 | 7181 | loss | 1536 | CLSTN1 | 21.04 | Intron + ve, ASD > 4, Normals < 2, no Sanger filter applied | 8 |
| 1 | 9769722 | 9776903 | 7181 | loss | 1546 | CLSTN1 | 21.04 | Intron + ve, ASD > 4, Normals < 2, no Sanger filter applied | 8 |
| 1 | 9769722 | 9776903 | 7181 | loss | 1551 | CLSTN1 | 21.04 | Intron + ve, ASD > 4, Normals < 2, no Sanger filter applied | 8 |
| 1 | 9769722 | 9776903 | 7181 | loss | 1573 | CLSTN1 | 21.04 | Intron + ve, ASD > 4, Normals < 2, no Sanger filter applied | 8 |
| 1 | 9769722 | 9776903 | 7181 | loss | 1602 | CLSTN1 | 21.04 | Intron + ve, ASD > 4, Normals < 2, no Sanger filter applied | 8 |
| 1 | 9769722 | 9776903 | 7181 | loss | 1648 | CLSTN1 | 21.04 | Intron + ve, ASD > 4, Normals < 2, no Sanger filter applied | 8 |
| 1 | 9769722 | 9776903 | 7181 | loss | 1658 | CLSTN1 | 21.04 | Intron + ve, ASD > 4, Normals < 2, no Sanger filter applied | 8 |
| 1 | 9769722 | 9776903 | 7181 | loss | 1734 | CLSTN1 | 21.04 | Intron + ve, ASD > 4, Normals < 2, no Sanger filter applied | 8 |
| 1 | 9769722 | 9776903 | 7181 | loss | 1740 | CLSTN1 | 21.04 | Intron + ve, ASD > 4, Normals < 2, no Sanger filter applied | 8 |
| 1 | 9769722 | 9776903 | 7181 | loss | 1923 | CLSTN1 | 21.04 | Intron + ve, ASD > 4, Normals < 2, no Sanger filter applied | 8 |
| 1 | 9769722 | 9776903 | 7181 | loss | 1301 | CLSTN1 | 22.58 | Intron + ve, ASD > 4, Normals < 2, no Sanger filter applied | 8 |
| 1 | 9769722 | 9776903 | 7181 | loss | 1474 | CLSTN1 | 22.58 | Intron + ve, ASD > 4, Normals < 2, no Sanger filter applied | 8 |
| 1 | 9769722 | 9776903 | 7181 | loss | 1487 | CLSTN1 | 22.58 | Intron + ve, ASD > 4, Normals < 2, no Sanger filter applied | 8 |
| 1 | 9769722 | 9776903 | 7181 | loss | 1533 | CLSTN1 | 22.58 | Intron + ve, ASD > 4, Normals < 2, no Sanger filter applied | 8 |
| 1 | 9769722 | 9776903 | 7181 | loss | 1536 | CLSTN1 | 22.58 | Intron + ve, ASD > 4, Normals < 2, no Sanger filter applied | 8 |
| 1 | 9769722 | 9776903 | 7181 | loss | 1546 | CLSTN1 | 22.58 | Intron + ve, ASD > 4, Normals < 2, no Sanger filter applied | 8 |
| 1 | 9769722 | 9776903 | 7181 | loss | 1551 | CLSTN1 | 22.58 | Intron + ve, ASD > 4, Normals < 2, no Sanger filter applied | 8 |
| 1 | 9769722 | 9776903 | 7181 | loss | 1573 | CLSTN1 | 22.58 | Intron + ve, ASD > 4, Normals < 2, no Sanger filter applied | 8 |
| 1 | 9769722 | 9776903 | 7181 | loss | 1602 | CLSTN1 | 22.58 | Intron + ve, ASD > 4, Normals < 2, no Sanger filter applied | 8 |
| 1 | 9769722 | 9776903 | 7181 | loss | 1648 | CLSTN1 | 22.58 | Intron + ve, ASD > 4, Normals < 2, no Sanger filter applied | 8 |
| 1 | 9769722 | 9776903 | 7181 | loss | 1658 | CLSTN1 | 22.58 | Intron + ve, ASD > 4, Normals < 2, no Sanger filter applied | 8 |
| 1 | 9769722 | 9776903 | 7181 | loss | 1734 | CLSTN1 | 22.58 | Intron + ve, ASD > 4, Normals < 2, no Sanger filter applied | 8 |
| 1 | 9769722 | 9776903 | 7181 | loss | 1740 | CLSTN1 | 22.58 | Intron + ve, ASD > 4, Normals < 2, no Sanger filter applied | 8 |
| 1 | 9769722 | 9776903 | 7181 | loss | 1923 | CLSTN1 | 22.58 | Intron + ve, ASD > 4, Normals < 2, no Sanger filter applied | 8 |
| 1 | 9772802 | 9776903 | 4101 | loss | 1436 | CLSTN1 | 22.58 | Intron + ve, ASD > 4, Normals < 2, no Sanger filter applied | 9 |
| 1 | 16713074 | 17155989 | 442915 | gain | 1501 | CROCC | 13.43 | Exon + ve, ASD > 4, Normals < 2, no Sanger filter applied | 318 |
| 1 | 16799711 | 17154037 | 354326 | loss | 1905 | CROCC | 13.43 | Exon + ve, ASD > 4, Normals < 2, no Sanger filter applied | 322 |
| 1 | 16799711 | 17154037 | 354326 | loss | 1949 | CROCC | 13.43 | Exon + ve, ASD > 4, Normals < 2, no Sanger filter applied | 322 |
| 1 | 16888048 | 17154037 | 265989 | loss | 1694 | CROCC | 13.43 | Exon + ve, ASD > 4, Normals < 2, no Sanger filter applied | 321 |
| 1 | 16888048 | 17154037 | 265989 | loss | 1947 | CROCC | 13.43 | Exon + ve, ASD > 4, Normals < 2, no Sanger filter applied | 321 |
| 1 | 17080364 | 17154037 | 73673 | loss | 1673 | CROCC | 13.43 | Exon + ve, ASD > 4, Normals < 2, no Sanger filter applied | 320 |
| 1 | 17080364 | 17154037 | 73673 | loss | 1677 | CROCC | 13.43 | Exon + ve, ASD > 4, Normals < 2, no Sanger filter applied | 320 |
| 1 | 17112697 | 17154037 | 11340 | loss | 1658 | CROCC | 13.43 | Exon + ve, ASD > 4, Normals < 2, no Sanger filter applied | 319 |
| 1 | 17114337 | 17154037 | 39700 | loss | 1256 | CROCC | 13.43 | Exon + ve, ASD > 4, Normals < 2, no Sanger filter applied | 317 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 1 | 31762404 | 31764282 | 1878 | loss | 1405 | LOC284551 | 10.51 | Genic (distinct CNV-subregions); OR > 6 | 387 |
| 1 | 31762404 | 31764282 | 1878 | loss | 1508 | LOC284551 | 10.51 | Genic (distinct CNV-subregions); OR > 6 | 387 |
| 1 | 31762404 | 31764282 | 1878 | loss | 1513 | LOC284551 | 10.51 | Genic (distinct CNV-subregions); OR > 6 | 387 |
| 1 | 31762404 | 31764282 | 1878 | loss | 1527 | LOC284551 | 10.51 | Genic (distinct CNV-subregions); OR > 6 | 387 |
| 1 | 31762404 | 31764282 | 1878 | loss | 1557 | LOC284551 | 10.51 | Genic (distinct CNV-subregions); OR > 6 | 387 |
| 1 | 31762404 | 31764282 | 1878 | loss | 1583 | LOC284551 | 10.51 | Genic (distinct CNV-subregions); OR > 6 | 387 |
| 1 | 31762404 | 31764282 | 1878 | loss | 1617 | LOC284551 | 10.51 | Genic (distinct CNV-subregions); OR > 6 | 387 |
| 1 | 31762404 | 31764282 | 1878 | loss | 1628 | LOC284551 | 10.51 | Genic (distinct CNV-subregions); OR > 6 | 387 |
| 1 | 31762404 | 31764282 | 1878 | loss | 1644 | LOC284551 | 10.51 | Genic (distinct CNV-subregions); OR > 6 | 387 |
| 1 | 31762404 | 31764282 | 1878 | loss | 1647 | LOC284551 | 10.51 | Genic (distinct CNV-subregions); OR > 6 | 387 |
| 1 | 31762404 | 31764282 | 1878 | loss | 1696 | LOC284551 | 10.51 | Genic (distinct CNV-subreaions); OR > 6 | 387 |
| 1 | 31762404 | 31764282 | 1878 | loss | 1811 | LOC284551 | 10.51 | Genic (distinct CNV-subregions); OR > 6 | 387 |
| 1 | 31762404 | 31764282 | 1878 | loss | 1836 | LOC284551 | 10.51 | Genic (distinct CNV-subregions); OR > 6 | 387 |
| 1 | 31762404 | 31764282 | 1878 | loss | 1908 | LOC284551 | 10.51 | Genic (distinct CNV-subregions); OR > 6 | 387 |
| 1 | 34876833 | 34884849 | 8016 | loss | 1239 | | 30.33 | high OR intergenic (OR > 30) | 207 |
| 1 | 34876833 | 34884849 | 8016 | loss | 1253 | | 30.33 | high OR intergenic (OR > 30) | 207 |
| 1 | 34876833 | 34884849 | 8016 | loss | 1291 | | 30.33 | high OR intergenic (OR > 30) | 207 |
| 1 | 34876833 | 34884849 | 8016 | loss | 1347 | | 30.33 | high OR intergenic (OR > 30) | 207 |
| 1 | 34876833 | 34884849 | 8016 | loss | 1439 | | 30.33 | high OR intergenic (OR > 30) | 207 |
| 1 | 34876833 | 34884849 | 8016 | loss | 1455 | | 30.33 | high OR intergenic (OR > 30) | 207 |
| 1 | 34876833 | 34884849 | 8016 | loss | 1474 | | 30.33 | high OR intergenic (OR > 30) | 207 |
| 1 | 34876833 | 34884849 | 8016 | loss | 1492 | | 30.33 | high OR intergenic (OR > 30) | 207 |
| 1 | 34876833 | 34884849 | 8016 | loss | 1511 | | 30.33 | high OR intergenic (OR > 30) | 207 |
| 1 | 34876833 | 34884849 | 8016 | loss | 1564 | | 30.33 | high OR intergenic (OR > 30) | 207 |
| 1 | 34876833 | 34884849 | 8016 | loss | 1598 | | 30.33 | high OR intergenic (OR > 30) | 207 |
| 1 | 34876833 | 34884849 | 8016 | loss | 1601 | | 30.33 | high OR intergenic (OR > 30) | 207 |
| 1 | 34876833 | 34884849 | 8016 | loss | 1641 | | 30.33 | high OR intergenic (OR > 30) | 207 |
| 1 | 34876833 | 34884849 | 8016 | loss | 1646 | | 30.33 | high OR intergenic (OR > 30) | 207 |
| 1 | 34876833 | 34884849 | 8016 | loss | 1717 | | 30.33 | high OR intergenic (OR > 30) | 207 |
| 1 | 34876833 | 34884849 | 8016 | loss | 1786 | | 30.33 | high OR intergenic (OR > 30) | 207 |
| 1 | 34876833 | 34884849 | 8016 | loss | 1827 | | 30.33 | high OR intergenic (OR > 30) | 207 |
| 1 | 34876833 | 34886493 | 9660 | loss | 1928 | | 30.33 | high OR intergenic (OR > 30) | 209 |
| 1 | 34876833 | 34884849 | 8016 | loss | 2005 | | 30.33 | high OR intergenic (OR > 30) | 207 |
| 1 | 34878816 | 34884849 | 6033 | loss | 1643 | | 30.33 | high OR intergenic (OR > 30) | 205 |
| 1 | 54862228 | 54876067 | 13839 | loss | 1677 | ACOT11 | 10.41 | Exon + ve, ASD > 4, Normals < 2, no Sanger filter applied | 389 |
| 1 | 54862228 | 54876067 | 13839 | loss | 1721 | ACOT11 | 10.41 | Exon + ve, ASD > 4, Normals < 2, no Sanger filter applied | 389 |
| 1 | 54862228 | 54876067 | 13839 | loss | 1915 | ACOT11 | 10.41 | Exon + ve, ASD > 4, Normals < 2, no Sanger filter applied | 389 |
| 1 | 54864879 | 54879813 | 14934 | loss | 1908 | ACOT11 | 10.41 | Exon + ve, ASD > 4, Normals < 2, no Sanger filter applied | 390 |
| 1 | 54864879 | 54876067 | 11188 | loss | 2028 | ACOT11 | 10.41 | Exon + ve, ASD > 4, Normals < 2, no Sanger filter applied | 391 |
| 1 | 54866506 | 54876067 | 9561 | loss | 1668 | ACOT11 | 10.41 | Exon + ve, ASD > 4, Normals < 2, no Sanger filter applied | 388 |
| 1 | 54866506 | 54876067 | 9561 | loss | 1729 | ACOT11 | 10.41 | Exon + ve, ASD > 4, Normals < 2, no Sanger filter applied | 388 |
| 1 | 68435695 | 68436445 | 750 | loss | 1259 | WLS | 16.46 | Intron + ve, ASD > 4, Normals < 2, no Sanger filter applied | 264 |
| 1 | 68435695 | 68436445 | 750 | loss | 1267 | WLS | 16.46 | Intron + ve, ASD > 4, Normals < 2, no Sanger filter applied | 264 |
| 1 | 68435695 | 68436445 | 750 | loss | 1344 | WLS | 16.46 | Intron + ve, ASD > 4, Normals < 2, no Sanger filter applied | 264 |
| 1 | 68435695 | 68436445 | 750 | loss | 1345 | WLS | 16.46 | Intron + ve, ASD > 4, Normals < 2, no Sanger filter applied | 264 |
| 1 | 68435695 | 68436445 | 750 | loss | 1510 | WLS | 16.46 | Intron + ve, ASD > 4, Normals < 2, no Sanger filter applied | 264 |
| 1 | 68435695 | 68436445 | 750 | loss | 1563 | WLS | 16.46 | Intron + ve, ASD > 4, Normals < 2, no Sanger filter applied | 264 |
| 1 | 68435695 | 68436445 | 750 | loss | 1594 | WLS | 16.46 | Intron + ve, ASD > 4, Normals < 2, no Sanger filter applied | 264 |
| 1 | 68435695 | 68436445 | 750 | loss | 1640 | WLS | 16.46 | Intron + ve, ASD > 4, Normals < 2, no Sanger filter applied | 264 |
| 1 | 68435695 | 68436445 | 750 | loss | 1750 | WLS | 16.46 | Intron + ve, ASD > 4, Normals < 2, no Sanger filter applied | 261 |
| 1 | 68435695 | 68436445 | 750 | loss | 1826 | WLS | 16.46 | Intron + ve, ASD > 4, Normals < 2, no Sanger filter applied | 264 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 1 | 68435695 | 68436445 | 750 | loss | 1852 | WLS | 16.46 | Intron + ve, ASD > 4, Normals < 2, no Sanger filter applied | 264 |
| 1 | 71091004 | 71094314 | 3310 | loss | 1739 | PTGER3 | 5.92 | Exon + ve, 5 > ASD > 1, Normals < 2, Sanger − ve | 610 |
| 1 | 71091004 | 71094314 | 3310 | loss | 1802 | PTGER3 | 5.92 | Exon + ve, 5 > ASD > 1, Normals < 2, Sanger − ve | 610 |
| 1 | 71091004 | 71094314 | 3310 | loss | 1837 | PTGER3 | 5.92 | Exon + ve, 5 > ASD > 1, Normals < 2, Sanger − ve | 640 |
| 1 | 71091004 | 71094314 | 3310 | loss | 1844 | PTGER3 | 5.92 | Exon + ve, 5 > ASD > 1, Normals < 2, Sanger − ve | 640 |
| 1 | 71103367 | 71113670 | 10303 | gain | 1259 | PTGER3 | 2.95 | Exon + ve, 5 > ASD > 1, Normals < 2, Sanger − ve | 739 |
| 1 | 71106139 | 71121446 | 15307 | gain | 2041 | PTGER3 | 2.95 | Exon + ve, 5 > ASD > 1, Normals < 2, Sanger − ve | 740 |
| 1 | 102231556 | 102237620 | 6064 | loss | 1284 | OLFM3 | 2.95 | Exon + ve, 5 > ASD > 1, Normals < 2, Sanger − ve | 741 |
| 1 | 102231556 | 102241226 | 9670 | loss | 1862 | OLFM3 | 2.95 | Exon + ve, 5 > ASD > 1, Normals < 2, Sanger − ve | 742 |
| 1 | 103832879 | 104012520 | 179641 | gain | 1567 | AMY2B | 7.42 | Intron + ve, ASD > 4, Normals < 2, no Sanger filter applied | 526 |
| 1 | 103899771 | 104012520 | 112749 | gain | 1317 | AMY2B | 7.42 | Intron + ve, ASD > 4, Normals < 2, no Sanger filter applied | 525 |
| 1 | 103899771 | 103962495 | 62724 | gain | 1955 | AMY2B | 7.42 | Intron + ve, ASD > 4, Normals < 2, no Sanger filter applied | 527 |
| 1 | 103901454 | 103962495 | 61041 | gain | 1991 | AMY2B | 7.42 | Intron + ve, ASD > 4, Normals < 2, no Sanger filter applied | 528 |
| 1 | 103904723 | 104012520 | 107797 | gain | 2032 | AMY2B | 7.42 | Intron + ve, ASD > 4, Normals < 2, no Sanger filter applied | 529 |
| 1 | 105838975 | 106062421 | 223446 | loss | 2024 | | 46.2 | high OR intergenic (OR > 30) | 849 |
| 1 | 105838975 | 106062421 | 223446 | loss | 2024 | | 49.43 | high OR intergenic (OR > 30) | 519 |
| 1 | 105882119 | 105931012 | 48893 | loss | 1416 | | 46.2 | high OR intergenic (OR > 30) | 845 |
| 1 | 105882119 | 105931012 | 48893 | loss | 1947 | | 49.43 | high OR intergenic (OR > 30) | 845 |
| 1 | 105882119 | 105931012 | 48893 | loss | 1947 | | 49.43 | high OR intergenic (OR > 30) | 845 |
| 1 | 105890374 | 105931012 | 40638 | loss | 1253 | | 46.2 | high OR intergenic (OR > 30) | 842 |
| 1 | 105890374 | 105931012 | 40638 | loss | 1324 | | 46.2 | high OR intergenic (OR > 30) | 844 |
| 1 | 105890374 | 105938579 | 48205 | loss | 1494 | | 46.2 | high OR intergenic (OR > 30) | 842 |
| 1 | 105890374 | 105931012 | 40638 | loss | 1502 | | 46.2 | high OR intergenic (OR > 30) | 842 |
| 1 | 105890374 | 105931012 | 40638 | loss | 1515 | | 46.2 | high OR intergenic (OR > 30) | 842 |
| 1 | 105890374 | 105931012 | 40638 | loss | 1557 | | 46.2 | high OR intergenic (OR > 30) | 842 |
| 1 | 105890374 | 105931012 | 40638 | loss | 1564 | | 46.2 | high OR intergenic (OR > 30) | 842 |
| 1 | 105890374 | 105931012 | 40638 | loss | 1717 | | 46.2 | high OR intergenic (OR > 30) | 842 |
| 1 | 105890374 | 105931012 | 40638 | loss | 1741 | | 46.2 | high OR intergenic (OR > 30) | 842 |
| 1 | 105890374 | 105931012 | 40638 | gain | 1810 | | 46.2 | high OR intergenic (OR > 30) | 842 |
| 1 | 105890374 | 105931012 | 40638 | loss | 1915 | | 46.2 | high OR intergenic (OR > 30) | 842 |
| 1 | 105890574 | 105938579 | 48205 | loss | 1253 | | 49.43 | high OR intergenic (OR > 30) | 842 |
| 1 | 105890574 | 105931012 | 40638 | loss | 1324 | | 49.43 | high OR intergenic (OR > 30) | 844 |
| 1 | 105890574 | 105931012 | 40638 | loss | 1494 | | 49.43 | high OR intergenic (OR > 30) | 544 |
| 1 | 105890574 | 105931012 | 40638 | loss | 1502 | | 49.43 | high OR intergenic (OR > 30) | 542 |
| 1 | 105890574 | 105931012 | 40638 | loss | 1515 | | 49.43 | high OR intergenic (OR > 30) | 842 |
| 1 | 105890574 | 105931012 | 40638 | loss | 1557 | | 49.43 | high OR intergenic (OR > 30) | 842 |
| 1 | 105890574 | 105931012 | 40638 | loss | 1564 | | 49.43 | high OR intergenic (OR > 30) | 842 |
| 1 | 105890574 | 105931012 | 40638 | loss | 1717 | | 49.43 | high OR intergenic (OR > 30) | 842 |
| 1 | 105890574 | 105931012 | 40638 | loss | 1741 | | 49.43 | high OR intergenic (OR > 30) | 842 |
| 1 | 105890574 | 105931012 | 40638 | gain | 1810 | | 49.43 | high OR intergenic (OR > 30) | 842 |
| 1 | 105890574 | 105931012 | 40638 | loss | 1915 | | 49.43 | high OR intergenic (OR > 30) | 842 |
| 1 | 105900548 | 105931012 | 30464 | loss | 1287 | | 46.2 | high OR intergenic (OR > 30) | 843 |
| 1 | 105900548 | 105931012 | 30464 | loss | 1337 | | 46.2 | high OR intergenic (OR > 30) | 843 |
| 1 | 105900548 | 105931012 | 50464 | loss | 1521 | | 46.2 | high OR intergenic (OR > 30) | 843 |
| 1 | 105900548 | 105931012 | 30464 | gain | 1558 | | 46.2 | high OR intergenic (OR > 30) | 843 |
| 1 | 105900548 | 105931012 | 30464 | loss | 1566 | | 46.2 | high OR intergenic (OR > 30) | 843 |
| 1 | 105900548 | 105938579 | 38031 | loss | 1659 | | 46.2 | high OR intergenic (OR > 30) | 847 |
| 1 | 105900548 | 105931012 | 30464 | gain | 1787 | | 46.2 | high OR intergenic (OR > 30) | 843 |
| 1 | 105900548 | 105931012 | 30464 | loss | 1832 | | 46.2 | high OR intergenic (OR > 30) | 843 |
| 1 | 105900548 | 105931012 | 30464 | loss | 1955 | | 46.2 | high OR intergenic (OR > 30) | 843 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 1 | 105900548 | 105931012 | 30464 | loss | 1959 | | 16.2 | high OR intergenic (OR > 30) | 843 |
| 1 | 105900548 | 105938579 | 38031 | loss | 1994 | | 46.2 | high OR intergenic (OR > 30) | 847 |
| 1 | 105900545 | 105931012 | 30464 | loss | 2005 | | 46.2 | high OR intergenic (OR > 30) | 843 |
| 1 | 105900545 | 105931012 | 30464 | loss | 1287 | | 49.43 | high OR intergenic (OR > 30) | 843 |
| 1 | 105900548 | 105931012 | 30464 | gain | 1337 | | 49.43 | high OR intergenic (OR > 30) | 843 |
| 1 | 105900548 | 105931012 | 30464 | loss | 1521 | | 49.43 | high OR intergenic (OR > 30) | 843 |
| 1 | 105900548 | 105931012 | 30464 | loss | 1558 | | 49.43 | high OR intergenic (OR > 30) | 843 |
| 1 | 105900548 | 105931012 | 30464 | loss | 1566 | | 49.43 | high OR intergenic (OR > 30) | 843 |
| 1 | 105900548 | 105938579 | 38031 | loss | 1659 | | 49.43 | high OR intergenic (OR > 30) | 847 |
| 1 | 105900548 | 105931012 | 30464 | gain | 1787 | | 49.43 | high OR intergenic (OR > 30) | 843 |
| 1 | 105900548 | 105931012 | 30464 | loss | 1832 | | 49.43 | high OR intergenic (OR > 30) | 843 |
| 1 | 105900548 | 105931012 | 30464 | loss | 1955 | | 49.43 | high OR intergenic (OR > 30) | 843 |
| 1 | 105900548 | 105931012 | 30464 | loss | 1959 | | 49.43 | high OR intergenic (OR > 30) | 843 |
| 1 | 105900548 | 105938579 | 38031 | loss | 1994 | | 49.43 | high OR intergenic (OR > 30) | 847 |
| 1 | 105900548 | 105931012 | 30464 | loss | 2005 | | 49.43 | high OR intergenic (OR > 30) | 843 |
| 1 | 105909959 | 105931012 | 21053 | loss | 1250 | | 49.43 | high OR intergenic (OR > 30) | 841 |
| 1 | 105909959 | 105931012 | 21053 | gain | 1410 | | 46.2 | high OR intergenic (OR > 30) | 841 |
| 1 | 105909959 | 105926088 | 16129 | loss | 1765 | | 46.2 | high OR intergenic (OR > 30) | 848 |
| 1 | 105909959 | 105931012 | 21053 | loss | 1766 | | 46.2 | high OR intergenic (OR > 30) | 841 |
| 1 | 105909959 | 105931012 | 21053 | loss | 1250 | | 49.43 | high OR intergenic (OR > 30) | 841 |
| 1 | 105909959 | 105931012 | 21053 | gain | 1410 | | 49.43 | high OR intergenic (OR > 30) | 841 |
| 1 | 105909959 | 105926088 | 16129 | loss | 1765 | | 49.43 | high OR intergenic (OR > 30) | 848 |
| 1 | 105909959 | 105931012 | 21053 | loss | 1766 | | 49.43 | high OR intergenic (OR > 30) | 841 |
| 1 | 105917569 | 105931012 | 13443 | gain | 1522 | | 49.43 | high OR intergenic (OR > 30) | 846 |
| 1 | 105917569 | 105931012 | 13443 | gain | 1563 | | 49.43 | high OR intergenic (OR > 30) | 846 |
| 1 | 113799262 | 113807947 | 8685 | loss | 1426 | MAGI3 | 10.41 | Intron + ve, ASD > 4, Normals < 2, no Sanger filter applied | 351 |
| 1 | 113799262 | 113807947 | 8685 | loss | 1442 | MAGI3 | 10.41 | Intron + ve, ASD > 4, Normals < 2, no Sanger filter applied | 351 |
| 1 | 113799262 | 113807947 | 8685 | loss | 1443 | MAGI3 | 10.41 | Intron + ve, ASD > 4, Normals < 2, no Sanger filter applied | 351 |
| 1 | 113799262 | 113807947 | 8685 | loss | 1476 | MAGI3 | 10.41 | Intron + ve, ASD > 4, Normals < 2, no Sanger filter applied | 351 |
| 1 | 113799262 | 113807947 | 8685 | loss | 1500 | MAGI3 | 10.41 | Intron + ve, ASD > 4, Normals < 2, no Sanger filter applied | 351 |
| 1 | 113799262 | 113807947 | 8685 | loss | 1505 | MAGI3 | 10.41 | Intron + ve, ASD > 4, Normals < 2, no Sanger filter applied | 351 |
| 1 | 113799262 | 113807947 | 8685 | loss | 1525 | MAGI3 | 10.41 | Intron + ve, ASD > 4, Normals < 2, no Sanger filter applied | 351 |
| 1 | 113799262 | 113807947 | 8685 | loss | 1426 | MAGI3 | 11.92 | Intron + ve, ASD > 4, Normals < 2, no Sanger filter applied | 351 |
| 1 | 113799262 | 113807947 | 8685 | loss | 1442 | MAGI3 | 11.92 | Intron + ve, ASD > 4, Normals < 2, no Sanger filter applied | 351 |
| 1 | 113799262 | 113807947 | 8685 | loss | 1443 | MAGI3 | 11.92 | Intron + ve, ASD > 4, Normals < 2, no Sanger filter applied | 351 |
| 1 | 113799262 | 113807947 | 8685 | loss | 1476 | MAGI3 | 11.92 | Intron + ve, ASD > 4, Normals < 2, no Sanger filter applied | 351 |
| 1 | 113799262 | 113807947 | 8685 | loss | 1500 | MAGI3 | 11.92 | Intron + ve, ASD > 4, Normals < 2, no Sanger filter applied | 351 |
| 1 | 113799262 | 113807947 | 8685 | loss | 1505 | MAGI3 | 11.92 | Intron + ve, ASD > 4, Normals < 2, no Sanger filter applied | 351 |
| 1 | 113799262 | 113807947 | 8685 | loss | 1525 | MAGI3 | 11.92 | Intron + ve, ASD > 4, Normals < 2, no Sanger filter applied | 351 |
| 1 | 113799262 | 113807947 | 8685 | gain | 1590 | MAGI3 | 11.92 | Intron + ve, ASD > 4, Normals < 2, no Sanger filter applied | 351 |
| 1 | 113801663 | 113807947 | 6284 | gain | 1599 | MAGI3 | 11.92 | Intron + ve, ASD > 4, Normals < 2, no Sanger filter applied | 352 |
| 1 | 141559466 | 144093719 | 2534253 | gain | 1599 | SEC22B | 2.95 | Exon + ve, 5 > ASD > 1, Normals < 2, Sanger − ve | 309 |
| 1 | 141559466 | 144093719 | 2534253 | gain | 1599 | SEC22B | 4.44 | Exon + ve, 5 > ASD > 1, Normals < 2, Sanger − ve | 309 |
| 1 | 141559466 | 144093719 | 2534253 | gain | 1599 | NBPF9, LOC653513, PPIAL4A, PDE4DIP, PPIAL4C, PPIAL4B, LOC728855, LOC728875, SRGAP2P2,C1orf152 | 13.95 | Genic (distinct CNV-subregions); OR > 6 | |
| 1 | 143820820 | 144003068 | 182248 | gain | 1617 | SEC22B | 2.95 | Exon + ve, 5 > ASD > 1, Normals < 2, Sanger − ve | 671 |
| 1 | 143820820 | 144003068 | 182248 | gain | 1617 | SEC22B | 4.44 | Exon + ve, 5 > ASD > 1, Normals < 2, Sanger − ve | 671 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 1 | 143822873 | 144003068 | 180195 | gain | 1713 | SEC22B | 4.44 | Exon + ve, 5 > ASD > 1, Normals < 2, Sanger − ve | 672 |
| 1 | 147306304 | 148081741 | 775437 | gain | 1293 | HIST2H3A, LOC728855, HIST2H2AA4, HIST2H3D, HIST2H3C, HIST2H2BF, FCGR1A, HIST2H2AA3, HIST2H4B, HIST2H4A | 16.46 | Exon + ve, ASD > 4, Normals < 2, no Sanger filter applied | 265 |
| 1 | 147306304 | 148081741 | 775437 | gain | 1294 | HIST2H3A, LOC728855, HIST2H2AA4, HIST2H3D, HIST2H3C, HIST2H2BF, FCGR1A, HIST2H2AA3, HIST2H4B, HIST2H4A | 16.46 | Exon + ve, ASD > 4, Normals < 2, no Sanger filter applied | 265 |
| 1 | 147306304 | 148081741 | 775437 | gain | 1293 | PPIAL4A, PPIAL4C, FCGR1C, LOC728855 | 13.95 | Genic (distinct CNV-subregions); OR > 6 | 265 |
| 1 | 147306304 | 148081741 | 775437 | gain | 1294 | PPIAL4A, PPIAL4C, FCGR1C, LOC728855 | 13.95 | Genic (distinct CNV-subregions); OR > 6 | 265 |
| 1 | 147306304 | 147847659 | 541355 | gain | 1387 | PPIAL4A, PPIAL4C, FCGR1C, LOC728855 | 13.95 | Genic (distinct CNV-subregions); OR > 6 | 312 |
| 1 | 147308557 | 148088285 | 779728 | loss | 2022 | HIST2H3A, LOC728855, HIST2H2AA4, HIST2H3D, HIST2H3C, HIST2H2BF, FCGR1A, HIST2H2AA3, HIST2H4B, HIST2H4A | 16.46 | Exon + ve, ASD > 4, Normals < 2, no Sanger filter applied | 271 |
| 1 | 147308557 | 148088285 | 779728 | loss | 2029 | HIST2H3A, LOC728855, HIST2H2AA4, HIST2H3D, HIST2H3C, HIST2H2BF, FCGR1A, HIST2H2AA3, HIST2H4B, HIST2H4A | 16.46 | Exon + ve, ASD > 4, Normals < 2, no Sanger filter applied | 271 |
| 1 | 147308557 | 147847659 | 539102 | loss | 1414 | PPIAL4A, PPIAL4C, FCGR1C, LOC728855 | 13.95 | Genic (distinct CNV-subregions); OR > 6 | 313 |
| 1 | 147308557 | 147847659 | 539102 | loss | 1442 | PPIAL4A, PPIAL4C, FCGR1C, LOC728855 | 13.95 | Genic (distinct CNV-subregions); OR > 6 | 313 |
| 1 | 147308557 | 147847659 | 539102 | loss | 1476 | PPIAL4A, PPIAL4C, FCGR1C, LOC728855 | 13.95 | Genic (distinct CNV-subregions); OR > 6 | 313 |
| 1 | 147308557 | 147847659 | 539102 | loss | 1526 | PPIAL4A, PPIAL4C, FCGR1C, LOC728855 | 13.95 | Genic (distinct CNV-subregions); OR > 6 | 313 |
| 1 | 147308557 | 147847659 | 539102 | loss | 1821 | PPIAL4A, PPIAL4C, FCGR1C, LOC728855 | 13.95 | Genic (distinct CNV-subregions); OR > 6 | 313 |
| 1 | 147308557 | 147847659 | 539102 | loss | 1827 | PPIAL4A, PPIAL4C, FCGR1C, LOC728855 | 13.95 | Genic (distinct CNV-subregions); OR > 6 | 313 |
| 1 | 147308557 | 147847659 | 539102 | loss | 1910 | PPIAL4A, PPIAL4C, FCGR1C, LOC728855 | 13.95 | Genic (distinct CNV-subregions); OR > 6 | 313 |
| 1 | 147308557 | 147847659 | 539102 | loss | 1913 | PPIAL4A, PPIAL4C, FCGR1C, LOC728855 | 13.95 | Genic (distinct CNV-subresions); OR > 6 | 313 |
| 1 | 147308557 | 147847659 | 539102 | loss | 1943 | PPIAL4A, PPIAL4C, FCGR1C, LOC728855 | 13.95 | Genic (distinct CNV-subregions); OR > 6 | 313 |
| 1 | 147308557 | 147847659 | 539102 | loss | 1961 | PPIAL4A, PPIAL4C, FCGR1C, LOC728855 | 13.95 | Genic (distinct CNV-subregions); OR > 6 | 313 |
| 1 | 147308557 | 147847659 | 539102 | loss | 2002 | PPIAL4A, PPIAL4C, FCGR1C, LOC728855 | 13.95 | Genic (distinct CNV-subregions); OR > 6 | 313 |
| 1 | 147308557 | 148088285 | 779728 | loss | 2022 | PPIAL4A, PPIAL4C, FCGR1C, LOC728855 | 13.95 | Genic (distinct CNV-subregions); OR > 6 | 271 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 1 | 147308557 | 148088285 | 779728 | loss | 2029 | PPIAL4A, PPIAL4C, FCGR1C, LOC728855 | 13.95 | Genic (distinct CNV-subregions); OR > 6 | 271 |
| 1 | 147311437 | 147847659 | 536222 | loss | 1276 | PPIAL4A, PPIAL4C, FCGR1C, LOC728855 | 13.95 | Genic (distinct CNV-subregions); OR > 6 | 311 |
| 1 | 147311437 | 147847659 | 536222 | loss | 1782 | PPIAL4A, PPIAL4C, FCGR1C, LOC728855 | 13.95 | Genic (distinct CNV-subregions); OR > 6 | 311 |
| 1 | 147313991 | 148081769 | 767778 | loss | 1686 | HIST2H3A, LOC728855, HIST2H2AA4, HIST2H3D, HIST2H3C, HIST2H2BF, FCGR1A, HIST2H2AA3, HIST2H4B, HIST2H4A | 16.46 | Exon + ve, ASD > 4, Normals < 2, no Sanger filter applied | 266 |
| 1 | 147313991 | 148088285 | 774294 | loss | 1739 | HIST2H3A, LOC728855, HIST2H2AA4, HIST2H3D, HIST2H3C, HIST2H2BF, FCGR1A, HIST2H2AA3, HIST2H4B, HIST2H4A | 16.46 | Exon + ve, ASD > 4, Normals < 2, no Sanger filter applied | 267 |
| 1 | 147313991 | 148088285 | 774294 | loss | 1757 | HIST2H3A, LOC728855, HIST2H2AA4, HIST2H3D, HIST2H3C, HIST2H2BF, FCGR1A, HIST2H2AA3, HIST2H4B, HIST2H4A | 16.46 | Exon + ve, ASD > 4, Normals < 2, no Sanger filter applied | 267 |
| 1 | 147315901 | 148088285 | 774294 | loss | 1947 | HIST2H3A, LOC728855, HIST2H2AA4, HIST2H3D, HIST2H3C, HIST2H2BF, FCGR1A, HIST2H2AA3, HIST2H4B, HIST2H4A | 16.46 | Exon + ve, ASD > 4, Normals < 2, no Sanger filter applied | 267 |
| 1 | 147313991 | 147847659 | 533668 | loss | 1539 | PPIAL4A, PPIAL4C, FCGR1C, LOC728855 | 13.95 | Genic (distinct CNV-subregions); OR > 6 | 314 |
| 1 | 147313991 | 147847659 | 533668 | loss | 1573 | PPIAL4A, PPIAL4C, FCGR1C, LOC728855 | 13.95 | Genic (distinct CNV-subregions); OR > 6 | 314 |
| 1 | 147313991 | 148081769 | 767778 | loss | 1686 | PPIAL4A, PPIAL4C, FCGR1C, LOC728855 | 13.95 | Genic (distinct CNV-subregions); OR > 6 | 266 |
| 1 | 147313991 | 148088285 | 774294 | loss | 1739 | PPIAL4A, PPIAL4C, FCGR1C, LOC728855 | 13.95 | Genic (distinct CNV-subregions); OR > 6 | 267 |
| 1 | 147313991 | 147847659 | 533668 | loss | 1744 | PPIAL4A, PPIAL4C, FCGR1C, LOC728855 | 13.95 | Genic (distinct CNV-subregions); OR > 6 | 314 |
| 1 | 147313991 | 148088285 | 774294 | loss | 1757 | PPIAL4A, PPIAL4C, FCGR1C, LOC728855 | 13.95 | Genic (distinct CNV-subregions); OR > 6 | 267 |
| 1 | 147313991 | 147847659 | 533668 | loss | 1762 | PPIAL4A, PPIAL4C, FCGR1C, LOC728855 | 13.95 | Genic (distinct CNV-subregions); OR > 6 | 314 |
| 1 | 147313991 | 147847659 | 533668 | loss | 1917 | PPIAL4A, PPIAL4C, FCGR1C, LOC728855 | 13.95 | Genic (distinct CNV-subregions); OR > 6 | 314 |
| 1 | 147313991 | 148088285 | 774294 | loss | 1947 | PPIAL4A, PPIAL4C, FCGR1C, LOC728855 | 13.95 | Genic (distinct CNV-subregions); OR > 6 | 267 |
| 1 | 147315217 | 148084402 | 769185 | loss | 1861 | HIST2H3A, LOC728855, HIST2H2AA4, HIST2H3D, HIST2H3C, HIST2H2BF, FCGR1A, HIST2H2AA3, H1ST2H4B, HIST2H4A | 16.46 | Exon + ve, ASD > 4, Normals < 2, no Sanger filter applied | 269 |
| 1 | 147315217 | 148115321 | 800104 | loss | 1954 | HIST2H3A, LOC728855, HIST2H2AA4, HIST2H3D, | 16.46 | Exon + ve, ASD > 4, Normals < 2, no Sanger filter applied | 270 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 1 | 147315217 | 147847659 | 532442 | loss | 1253 | HIST2H3C, HIST2H2BF, FCGR1A, HIST2H2AA3, HIST2H4B, HIST2H4A | 13.95 | Genic (distinct CNV-subregions); OR > 6 | 310 |
| 1 | 147315217 | 147847659 | 532442 | loss | 1318 | PPIAL4A, PPIAL4C, FCGR1C, LOC728855 | 13.95 | Genic (distinct CNV-subregions); OR > 6 | 310 |
| 1 | 147315217 | 147847659 | 532442 | loss | 1524 | PPIAL4A, PPIAL4C, FCGR1C, LOC728855 | 13.95 | Genic (distinct CNV-subregions); OR > 6 | 310 |
| 1 | 147315217 | 148084402 | 769185 | loss | 1861 | PPIAL4A, PPIAL4C, FCGR1C, LOC728855 | 13.95 | Genic (distinct CNV-subregions); OR > 6 | 269 |
| 1 | 147315217 | 148115321 | 800104 | loss | 1954 | PPIAL4A, PPIAL4C, FCGR1C, LOC728855 | 13.95 | Genic (distinct CNV-subregions); OR > 6 | 270 |
| 1 | 147441409 | 147847659 | 406250 | loss | 1726 | PPIAL4A, PPIAL4C, FCGR1C, LOC728855 | 13.95 | Genic (distinct CNV-subregions); OR > 6 | 316 |
| 1 | 147471665 | 147847659 | 375994 | loss | 1585 | PPIAL4A, PPIAL4C, FCGR1C, LOC728855 | 13.95 | Genic (distinct CNV-subregions); OR > 6 | 315 |
| 1 | 147644831 | 148088285 | 443454 | loss | 1817 | HIST2H3A, LOC728855, HIST2H2AA4, HIST2H3D, HIST2H3C, HIST2H2BF, FCGR1A, HIST2H2AA3, HIST2H4B, HIST2H4A | 16.46 | Exon + ve, ASD > 4, Normals < 2, no Sanger filter applied | 268 |
| 1 | 147644831 | 148088285 | 443454 | loss | 1817 | PPIAL4A, PPIAL4C, FCGR1C, LOC728855 | 13.95 | Genic (distinct CNV-subregions); OR > 6 | 268 |
| 1 | 150712926 | 150935932 | 223006 | gain | 2018 | LCE3E | 7.42 | Exon + ve, ASD > 4, Normals < 2, no Sanger filter applied | 278 |
| 1 | 150712926 | 150935932 | 223006 | gain | 2018 | LCE3D | 16.46 | Exon + ve, ASD > 4, Normals < 2, no Sanger filter applied | 278 |
| 1 | 150796077 | 150819879 | 23802 | loss | 1224 | LCE3E | 7.42 | Exon + ve, ASD > 4, Normals < 2, no Sanger filter applied | 272 |
| 1 | 150796077 | 150839754 | 43677 | loss | 1487 | LCH3E | 7.42 | Exon + ve, ASD > 4, Normals < 2, no Sanger filter applied | 275 |
| 1 | 150796077 | 150823073 | 26996 | loss | 1750 | LCE3E | 7.42 | Exon + ve, ASD > 4, Normals < 2, no Sanger filter applied | 276 |
| 1 | 150796077 | 150819879 | 23802 | loss | 1759 | LCE3E | 7.42 | Exon + ve, ASD > 4, Normals < 2, no Sanger filter applied | 272 |
| 1 | 150796077 | 150819879 | 23802 | loss | 1224 | LCE3D | 16.46 | Exon + ve, ASD > 4, Normals < 2, no Sanger filter applied | 272 |
| 1 | 150796077 | 150839754 | 43677 | loss | 1487 | LCE3D | 16.46 | Exon + ve, ASD > 4, Normals < 2, no Sanger filter applied | 275 |
| 1 | 150796077 | 150823073 | 26996 | loss | 1750 | LCE3D | 16.46 | Exon + ve, ASD > 4, Normals < 2, no Sanger filter applied | 276 |
| 1 | 150796077 | 150819879 | 23802 | loss | 1759 | LCE3D | 16.46 | Exon + ve, ASD > 4, Normals < 2, no Sanger filter applied | 272 |
| 1 | 150818222 | 150857070 | 38848 | gain | 1265 | LCE3D | 16.46 | Exon + ve, ASD > 4, Normals < 2, no Sanger filter applied | 273 |
| 1 | 150818222 | 150851439 | 33217 | gain | 1267 | LCE3D | 16.46 | Exon + ve, ASD > 4, Normals < 2, no Sanger filter applied | 274 |
| 1 | 150818222 | 150857070 | 38848 | gain | 1297 | LCF3D | 16.46 | Exon + ve, ASD > 4, Normals < 2, no Sanger filter applied | 273 |
| 1 | 150818222 | 150857070 | 38848 | gain | 1779 | LCE3D | 16.46 | Exon + ve, ASD > 4, Normals < 2, no Sanger filter applied | 273 |
| 1 | 150818222 | 150843192 | 24970 | gain | 1953 | LCE3D | 16.46 | Exon + ve, ASD > 4, Normals < 2, no Sanger filter applied | 277 |
| 1 | 150818222 | 150857070 | 38848 | gain | 2034 | LCE3D | 16.46 | Exon + ve, ASD > 4, Normals < 2, no Sanger filter applied | 273 |
| 1 | 181429536 | 181431556 | 2020 | loss | 1275 | LAMC2 | 25.67 | Intron + ve, ASD > 4, Normals < 2, no Sanger filter applied | 225 |
| 1 | 181429536 | 181431556 | 2020 | loss | 1277 | LAMC2 | 25.67 | Intron + ve, ASD > 4, Normals < 2, no Sanger filter applied | 225 |
| 1 | 181429536 | 181431556 | 2026 | loss | 1392 | LAMC2 | 25.67 | Intron + ve, ASD > 4, Normals < 2, no Sanger filter applied | 225 |
| 1 | 181429536 | 181431556 | 2020 | loss | 1410 | LAMC2 | 25.67 | Intron + ve, ASD > 4, Normals < 2, no Sanger filter applied | 225 |
| 1 | 181429536 | 181431556 | 2020 | loss | 1427 | LAMC2 | 25.67 | Intron + ve, ASD > 4, Normals < 2, no Sanger filter applied | 225 |
| 1 | 181429536 | 181431556 | 2020 | loss | 1696 | LAMC2 | 25.67 | Intron + ve, ASD > 4, Normals < 2, no Sanger filter applied | 225 |
| 1 | 181429536 | 181431556 | 2020 | loss | 1697 | LAMC2 | 25.67 | Intron + ve, ASD > 4, Normals < 2, no Sanger filter applied | 225 |
| 1 | 181429536 | 181431556 | 2020 | loss | 1774 | LAMC2 | 25.67 | Intron + ve, ASD > 4, Normals < 2, no Sanger filter applied | 225 |
| 1 | 181429536 | 181431556 | 2020 | loss | 1777 | LAMC2 | 25.67 | Intron + ve, ASD > 4, Normals < 2, no Sanger filter applied | 225 |
| 1 | 181429536 | 181431556 | 2020 | loss | 1778 | LAMC2 | 25.67 | Intron + ve, ASD > 4, Normals < 2, no Sanger filter applied | 225 |
| 1 | 181429536 | 181431556 | 2020 | loss | 1824 | LAMC2 | 25.67 | Intron + ve, ASD > 4, Normals < 2, no Sanger filter applied | 225 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 1 | 181429536 | 181431556 | 2020 | loss | 1838 | LAMC2 | 25.67 | Intron + ve, ASD > 4, Normals • 2, no Sanger filter applied | 225 |
| 1 | 181429536 | 181431556 | 2020 | loss | 1870 | LAMC2 | 25.67 | Intron + ve, ASD > 4, Normals < 2, no Sanger filter applied | 225 |
| 1 | 181429536 | 181431556 | 2020 | loss | 1893 | LAMC2 | 25.67 | Intron + ve, ASD > 4, Normals < 2, no Sanger filter applied | 225 |
| 1 | 181429536 | 181431556 | 2020 | loss | 1893 | LAMC2 | 25.67 | Intron + ve, ASD > 4, Normals < 2, no Sanger filter applied | 225 |
| 1 | 181429536 | 181431556 | 2020 | loss | 1950 | LAMC2 | 25.67 | Intron + ve, ASD > 4, Normals < 2, no Sanger filter applied | 225 |
| 1 | 181429536 | 181431556 | 2020 | loss | 1953 | LAMC2 | 25.67 | Intron + ve, ASD > 4, Normals < 2, no Sanger filter applied | 225 |
| 1 | 185128897 | 188537295 | 24398 | gain | 1788 | FAM5C | 7.42 | Intron + ve, ASD > 4, Normals < 2, no Sanger filter applied | 531 |
| 1 | 188526975 | 188537295 | 10320 | gain | 1354 | FAM5C | 7.42 | Intron + ve, ASD > 4, Normals < 2, no Sanger filter applied | 530 |
| 1 | 188526975 | 188537295 | 10320 | gain | 1596 | FAM5C | 7.42 | Intron + ve, ASD > 4, Normals < 2, no Sanger filter applied | 530 |
| 1 | 188526975 | 188537295 | 10320 | gain | 1669 | FAM5C | 7.42 | Intron + ve, ASD > 4, Normals < 2, no Sanger filter applied | 530 |
| 1 | 188526975 | 188537295 | 10320 | gain | 1742 | FAM5C | 7.42 | Intron + ve, ASD > 4, Normals < 2, no Sanger filter applied | 530 |
| 1 | 194971624 | 195095156 | 123532 | loss | 1291 | CFH | 8.91 | Exon + ve, ASD > 4, Normals < 2, no Sanger filter applied | 214 |
| 1 | 194971624 | 195095156 | 123532 | loss | 1440 | CFH | 8.91 | Exon + ve, ASD > 4, Normals < 2, no Sanger filter applied | 214 |
| 1 | 194971624 | 195065867 | 94243 | loss | 1712 | CFH | 8.91 | Exon + ve, ASD > 4, Normals < 2, no Sanger filter applied | 220 |
| 1 | 194971624 | 195095156 | 123532 | loss | 1291 | CFH | 27.22 | Exon + ve, ASD > 4, Normals < 2, no Sanger filter applied | 214 |
| 1 | 194971624 | 195095156 | 123532 | loss | 1440 | CFH | 27.22 | Exon + ve, ASD > 4, Normals < 2, no Sanger filter applied | 214 |
| 1 | 194971624 | 195065867 | 94243 | loss | 1712 | CFH | 27.22 | Exon + ve, ASD > 4, Normals < 2, no Sanger filter applied | 220 |
| 1 | 194977713 | 195097118 | 119405 | loss | 1572 | CFH | 8.91 | Exon + ve, ASD > 4, Normals < 2, no Sanger filter applied | 217 |
| 1 | 194977713 | 195065867 | 88154 | gain | 1591 | CFH | 8.91 | Exon + ve, ASD > 4, Normals < 2, no Sanger filter applied | 218 |
| 1 | 194977713 | 195097118 | 119405 | gain | 1665 | CFH | 8.91 | Exon + ve, ASD > 4, Normals < 2, no Sanger filter applied | 217 |
| 1 | 194977713 | 195097118 | 119405 | gain | 1572 | CFH | 27.22 | Exon + ve, ASD > 4, Normals < 2, no Sanger filter applied | 217 |
| 1 | 194977713 | 195065867 | 88154 | gain | 1591 | CFH | 27.22 | Exon + ve, ASD > 4, Normals < 2, no Sanger filter applied | 218 |
| 1 | 194978218 | 195097118 | 119405 | gain | 1665 | CFH | 27.22 | Exon + ve, ASD > 4, Normals < 2, no Sanger filter applied | 217 |
| 1 | 194978218 | 116938 | 116938 | loss | 1315 | CFH | 27.22 | Exon + ve, ASD > 4, Normals < 2, no Sanger filter applied | 215 |
| 1 | 194978218 | 195065867 | 87649 | loss | 1412 | CFH | 27.22 | Exon + ve, ASD > 4, Normals < 2, no Sanger filter applied | 216 |
| 1 | 194978218 | 195065867 | 87649 | loss | 1425 | CFH | 27.22 | Exon + ve, ASD > 4, Normals < 2, no Sanger filter applied | 216 |
| 1 | 194978218 | 195065867 | 87649 | loss | 1442 | CFH | 27.22 | Exon + ve, ASD > 4, Normals < 2, no Sanger filter applied | 216 |
| 1 | 194978218 | 195065867 | 87649 | loss | 1443 | CFH | 27.22 | Exon + ve, ASD > 4, Normals < 2, no Sanger filter applied | 216 |
| 1 | 194978218 | 116938 | 116938 | loss | 1493 | CFH | 27.22 | Exon + ve, ASD > 4, Normals < 2, no Sanger filter applied | 215 |
| 1 | 194978218 | 195065867 | 87649 | loss | 1494 | CFH | 27.22 | Exon + ve, ASD > 4, Normals < 2, no Sanger filter applied | 216 |
| 1 | 194978218 | 195095156 | 116938 | loss | 1503 | CFH | 27.22 | Exon ve, ASD > 4, Normals < 2, no Sanger filter applied | 215 |
| 1 | 194978218 | 195046932 | 68714 | loss | 1633 | CFH | 27.22 | Exon + ve, ASD > 4, Normals < 2, no Sanger filter applied | 219 |
| 1 | 194978218 | 195065867 | 87649 | loss | 1717 | CFH | 27.22 | Exon + ve, ASD > 4, Normals < 2, no Sanger filter applied | 216 |
| 1 | 194978218 | 195062793 | 84575 | loss | 1917 | CFH | 27.22 | Exon + ve, ASD > 4, Normals < 2, no Sanger filter applied | 221 |
| 1 | 194978218 | 195065867 | 87649 | loss | 1968 | CFH | 27.22 | Exon + ve, ASD > 4, Normals < 2, no Sanger filter applied | 216 |
| 1 | 199054239 | 199199515 | 145276 | gain | 1587 | CAMSAP1L1, C1orf106, GPR25 | 2.95 | Exon + ve, 5 > ASD > 1, Normals < 2, Sanger – ve | 743 |
| 1 | 199054239 | 199199515 | 145276 | gain | 1799 | CAMSAP1L1, C1orf106, GPR25 | 2.95 | Exon + ve, 5 > ASD > 1, Normals < 2, Sanger – ve | 743 |
| 1 | 209721622 | 209741682 | 20060 | loss | 1918 | RD3 | 4.44 | Exon + ve, 5 > ASD > 1, Normals > 1, Sanger – ve | 675 |
| 1 | 209723776 | 209741682 | 17906 | loss | 1804 | RD3 | 4.44 | Exon + ve, 5 > ASD > 1, Normals > 1, Sanger – ve | 674 |
| 1 | 209725571 | 209741682 | 16111 | loss | 1297 | RD3 | 4.44 | Kxon + ve, 5 > ASD > 1, Normals > 1, Sanger – ve | 673 |
| 1 | 242999910 | 244841528 | 1841618 | loss | 1767 | TFB2M | 2.95 | Exon + ve, 5 > ASD > 1, Normals < 2, Sanger – ve | 744 |
| 1 | 244191230 | 244851275 | 660045 | gain | 1819 | TFB2M | 2.95 | Exon + ve, 5 > ASD > 1, Normals < 2, Sanger – ve | 745 |
| 1 | 246769018 | 246862029 | 93011 | loss | 1664 | OR2T29 | 2.95 | Exon + ve, 5 > ASD > 1, Normals < 2, Sanger – ve | 746 |
| 1 | 246769018 | 246875016 | 105998 | loss | 1672 | OR2T29 | 2.95 | Exon + ve, 5 > ASD > 1, Normals < 2, Sanger – ve | 747 |
| 1 | 247069126 | 247073548 | 4422 | loss | 1678 | SH3BP5L | 2.95 | Exon + ve, 5 > ASD > 1, Normals < 2, Sanger – ve | 748 |
| 1 | 247071226 | 247073548 | 2022 | loss | 2022 | SH3BP5L | 2.95 | Exon + ve, 5 > ASD > 1, Normals < 2, Sanger – ve | 749 |
| 2 | 20234103 | 20236210 | 2107 | loss | 1272 | | 30.33 | high OR intergenic (OR > 30) | 210 |
| 2 | 20234103 | 20236210 | 2107 | loss | 1275 | | 30.33 | high OR intergenic (OR > 30) | 210 |
| 2 | 20234103 | 20236210 | 2107 | loss | 1104 | | 30.33 | high OR intergenic (OR > 30) | 210 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 2 | 20234103 | 20236210 | 2107 | loss | 1437 | | 30.33 | high OR intergenic (OR > 30) | 210 |
| 2 | 20234103 | 20236210 | 2107 | loss | 1443 | | 30.33 | high OR intergenic (OR > 30) | 210 |
| 2 | 20234103 | 20236210 | 2107 | loss | 1487 | | 30.33 | high OR intergenic (OR > 30) | 210 |
| 2 | 20234103 | 20236210 | 2107 | loss | 1488 | | 30.33 | high OR intergenic (OR > 30) | 210 |
| 2 | 20234103 | 20236210 | 2107 | loss | 1541 | | 30.33 | high OR intergenic (OR > 30) | 210 |
| 2 | 20234103 | 20236210 | 2107 | loss | 1594 | | 30.33 | high OR intergenic (OR > 30) | 210 |
| 2 | 20234103 | 20236210 | 2107 | loss | 1607 | | 30.33 | high OR intergenic (OR > 30) | 210 |
| 2 | 20234103 | 20236210 | 2107 | loss | 1665 | | 30.33 | high OR intergenic (OR > 30) | 210 |
| 2 | 20234103 | 20236210 | 2107 | loss | 1723 | | 30.33 | high OR intergenic (OR > 30) | 210 |
| 2 | 20234103 | 20236210 | 2107 | loss | 1726 | | 30.33 | high OR intergenic (OR > 30) | 210 |
| 2 | 20234103 | 20236210 | 2107 | loss | 1788 | | 30.33 | high OR intergenic (OR > 30) | 210 |
| 2 | 20234103 | 20236210 | 2107 | loss | 1813 | | 30.33 | high OR intergenic (OR > 30) | 210 |
| 2 | 20234103 | 20236210 | 2107 | loss | 1853 | | 30.33 | high OR intergenic (OR > 30) | 210 |
| 2 | 20234103 | 20236210 | 2107 | loss | 1879 | | 30.33 | high OR intergenic (OR > 30) | 210 |
| 2 | 20234103 | 20236210 | 2107 | loss | 1952 | | 30.33 | high OR intergenic (OR > 30) | 210 |
| 2 | 20234103 | 20236210 | 2107 | loss | 2020 | | 30.33 | high OR intergenic (OR > 30) | 210 |
| 2 | 20234103 | 20236210 | 2107 | loss | 2035 | | 30.33 | high OR intergenic (OR > 30) | 210 |
| 2 | 35556102 | 35562007 | 5905 | gain | 1230 | | 33.47 | high OR intergenic (OR > 30) | 875 |
| 2 | 35556102 | 35562007 | 5905 | gain | 1263 | | 33.47 | high OR intergenic (OR > 30) | 875 |
| 2 | 35556102 | 35562007 | 5905 | loss | 1271 | | 33.47 | high OR intergenic (OR > 30) | 875 |
| 2 | 35556102 | 35562007 | 5905 | loss | 1276 | | 33.47 | high OR intergenic (OR > 30) | 875 |
| 2 | 35556102 | 35562007 | 5905 | loss | 1286 | | 33.47 | high OR intergenic (OR > 30) | 875 |
| 2 | 35556102 | 35562007 | 5905 | gain | 1417 | | 33.47 | high OR intergenic (OR > 30) | 875 |
| 2 | 35556102 | 35562007 | 5905 | loss | 1456 | | 33.47 | high OR intergenic (OR > 30) | 875 |
| 2 | 35556102 | 35562007 | 5905 | loss | 1470 | | 33.47 | high OR intergenic (OR > 30) | 875 |
| 2 | 35556102 | 35562007 | 5905 | loss | 1568 | | 33.47 | high OR intergenic (OR > 30) | 875 |
| 2 | 35556102 | 35562007 | 5905 | gain | 1589 | | 33.47 | high OR intergenic (OR > 30) | 875 |
| 2 | 35556102 | 35562007 | 5905 | gain | 1606 | | 33.47 | high OR intergenic (OR > 30) | 875 |
| 2 | 35556102 | 35562007 | 5905 | gain | 1611 | | 33.47 | high OR intergenic (OR > 30) | 875 |
| 2 | 35556102 | 35562007 | 5905 | gain | 1612 | | 33.47 | high OR intergenic (OR > 30) | 875 |
| 2 | 35556102 | 35562007 | 5905 | gain | 1614 | | 33.47 | high OR intergenic (OR > 30) | 875 |
| 2 | 35556102 | 35562007 | 5905 | gain | 1637 | | 33.47 | high OR intergenic (OR > 30) | 875 |
| 2 | 35556102 | 35562007 | 5905 | gain | 1670 | | 33.47 | high OR intergenic (OR > 30) | 875 |
| 2 | 35556102 | 35562007 | 5905 | loss | 1726 | | 33.47 | high OR intergenic (OR > 30) | 875 |
| 2 | 35556102 | 35562007 | 5905 | gain | 1864 | | 33.47 | high OR intergenic (OR > 30) | 875 |
| 2 | 35556102 | 35562007 | 5905 | gain | 1881 | | 33.47 | high OR intergenic (OR > 30) | 875 |
| 2 | 35556102 | 35562007 | 5905 | gain | 1918 | | 33.47 | high OR intergenic (OR > 30) | 875 |
| 2 | 35556102 | 35565007 | 5965 | gain | 1956 | | 33.47 | high OR intergenic (OR > 30) | 875 |
| 2 | 35556102 | 35562007 | 5905 | gain | 1969 | | 33.47 | high OR intergenic (OR > 30) | 875 |
| 2 | 76849598 | 76866680 | 17082 | loss | 1599 | LRRTM4 | 8.24 | Genic (distinct CNV-subreaions); OR > 6 | 44 |
| 2 | 76849598 | 76866680 | 17082 | loss | 1599 | LRRTM4 | 8.24 | Genic (distinct CNV-subregions); OR > 6 | 44 |
| 2 | 76849598 | 76866680 | 17082 | loss | 1599 | LRRTM4 | 8.24 | Genic (distinct CNV-subregions); OR > 6 | 44 |
| 2 | 76854519 | 76863459 | 8940 | loss | 1254 | LRRTM4 | 8.24 | Genic (distinct CNV-subregions); OR > 6 | 45 |
| 2 | 76854519 | 76863459 | 8940 | loss | 1279 | LRRTM4 | 8.24 | Genic (distinct CNV-subreaions); OR > 6 | 45 |
| 2 | 76854519 | 76863459 | 8940 | loss | 1286 | LRRTM4 | 8.24 | Genic (distinct CNV-subreaions); OR > 6 | 45 |
| 2 | 76854519 | 76863459 | 8940 | loss | 1289 | LRRTM4 | 8.24 | Genic (distinct CNV-subreaions); OR > 6 | 45 |
| 2 | 76854519 | 76863459 | 8940 | loss | 1295 | LRRTM4 | 8.24 | Genic (distinct CNV-subreaions); OR > 6 | 45 |
| 2 | 76854519 | 76863459 | 8940 | loss | 1344 | LRRTM4 | 8.24 | Genic (distinct CNV-subregions); OR > 6 | 45 |
| 2 | 76854519 | 76863459 | 8940 | loss | 1424 | LRRTM4 | 8.24 | Genic (distinct CNV subregions); ()R 6 | 45 |
| 2 | 76854519 | 76863459 | 8940 | loss | 1456 | LRRTM4 | 8.24 | Genic (distinct CNV-subregions); OR > 6 | 45 |
| 2 | 76854519 | 76868055 | 13536 | loss | 1456 | LRRTM4 | 8.24 | Genic (distinct CNV-subreaions); OR > 6 | 46 |
| 2 | 76854519 | 76863459 | 8940 | loss | 1492 | LRRTM4 | 8.24 | Genic (distinct CNV-subregions); OR > 6 | 45 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 2 | 76854519 | 76863459 | 8940 | loss | 1495 | LRRTM4 | 8.24 | Genic (distinct CNV-subregions); OR > 6 | 45 |
| 2 | 76854519 | 76863459 | 8940 | loss | 1501 | LRRTM4 | 8.24 | Genic (distinct CNV-subregions); OR > 6 | 45 |
| 2 | 76854519 | 76863459 | 8940 | loss | 1512 | LRRTM4 | 8.24 | Genic (distinct CNV-subregions); OR > 6 | 45 |
| 2 | 76854519 | 76863459 | 8940 | loss | 1524 | LRRTM4 | 8.24 | Genic (distinct CNV-subregions); OR > 6 | 45 |
| 2 | 76854519 | 76868055 | 13536 | loss | 1525 | LRRTM4 | 8.24 | Genic (distinct CNV-subregions); OR > 6 | 46 |
| 2 | 76854519 | 76863459 | 8940 | gain | 1660 | LRRTM4 | 8.24 | Genic (distinct CNV-subregions); OR > 6 | 45 |
| 2 | 76854519 | 76863459 | 8940 | loss | 1711 | LRRTM4 | 8.24 | Genic (distinct CNV-subregions); OR > 6 | 45 |
| 2 | 76854519 | 76863459 | 8940 | loss | 1909 | LRRTM4 | 8.24 | Genic (distinct CNV-subregions); OR > 6 | 45 |
| 2 | 76854519 | 76863459 | 8940 | loss | 2031 | LRRTM4 | 8.24 | Genic (distinct CNV-subregions); OR > 6 | 45 |
| 2 | 76854519 | 76868055 | 13536 | loss | 1456 | LRRTM4 | 8.24 | Genic (distinct CNV-subregions); OR > 6 | 46 |
| 2 | 76854519 | 76868055 | 13536 | loss | 1525 | LRRTM4 | 8.24 | Genic (distinct CNV-subregions); OR > 6 | 46 |
| 2 | 76854519 | 76868055 | 13536 | loss | 1456 | LRRTM4 | 8.24 | Genic (distinct CNV-subregions); OR > 6 | 46 |
| 2 | 76854519 | 76868055 | 13536 | loss | 1525 | LRRTM4 | 8.24 | Genic (distinct CNV-subregions); OR > 6 | 46 |
| 2 | 77040204 | 77041952 | 1748 | loss | 1416 | LRRTM4 | 8.24 | Genic (distinct CNV-subregions); OR > 6 | 47 |
| 2 | 77040204 | 77041952 | 1748 | loss | 1418 | LRRTM4 | 8.24 | Genic (distinct CNV-subregions); OR > 6 | 47 |
| 2 | 77080924 | 77088262 | 7538 | loss | 1474 | LRRTM4 | 8.24 | Genic (distinct CNV-subregions); OR > 6 | 48 |
| 2 | 77080924 | 77083734 | 2810 | loss | 1822 | LRRTM4 | 8.24 | Genic (distinct CNV-subregions); OR > 6 | 49 |
| 2 | 77080924 | 77101859 | 20935 | loss | 1850 | LRRTM4 | 8.24 | Genic (distinct CNV-subregions); OR > 6 | 50 |
| 2 | 77080924 | 77088262 | 7338 | loss | 1474 | LRRTM4 | 8.24 | Genic (distinct CNV-subregions); OR > 6 | 48 |
| 2 | 77080924 | 77101859 | 20935 | loss | 1850 | LRRTM4 | 8.24 | Genic (distinct CNV-subregions); OR > 6 | 50 |
| 2 | 77080924 | 77101859 | 20935 | loss | 1850 | LRRTM4 | 8.24 | Genic (distinct CNV-subregions); OR > 6 | 50 |
| 2 | 77465598 | 77466768 | 1170 | loss | 1305 | LRRTM4 | 8.24 | Genic (distinct CNV-subregions); OR > 6 | 51 |
| 2 | 77465598 | 77466768 | 1170 | loss | 1347 | LRRTM4 | 8.24 | Genic (distinct CNV-subregions); OR > 6 | 51 |
| 2 | 77465598 | 77466768 | 1170 | loss | 1991 | LRRTM4 | 8.24 | Genic (distinct CNV-subregions); OR > 6 | 51 |
| 2 | 85465078 | 85500335 | 35257 | loss | 1928 | ELMOD3, CAPG | 2.95 | Exon + ve, 5 > ASD > 1, Normals < 2, Sanger – ve | 750 |
| 2 | 85465078 | 85500335 | 35257 | loss | 1928 | ELMOD3, CAPG | 2.95 | Exon + ve, 5 > ASD > 1, Normals < 2, Sanger – ve | 750 |
| 2 | 112206769 | 112337951 | 131182 | gain | 1498 | ANAPC1 | 11.92 | Exon + ve, ASD > 4, Normals < 2, no Sanger filter applied | 353 |
| 2 | 112263258 | 112337951 | 74693 | loss | 1814 | ANAPC1 | 11.92 | Exon + ve, ASD > 4, Normals < 2, no Sanger filter applied | 356 |
| 2 | 112307418 | 112337951 | 30533 | gain | 1558 | ANAPC1 | 11.92 | Exon + ve, ASD > 4, Normals < 2, no Sanger filter applied | 554 |
| 2 | 112308558 | 112337951 | 29393 | loss | 1794 | ANAPC1 | 11.92 | Exon + ve, ASD > 4, Normals < 2, no Sanger filter applied | 355 |
| 2 | 112308558 | 112337951 | 29393 | loss | 1810 | ANAPC1 | 11.92 | Exon + ve, ASD > 4, Normals < 2, no Sanger filter applied | 355 |
| 2 | 112308558 | 112337951 | 29393 | loss | 1833 | ANAPC1 | 11.92 | Exon + ve, ASD > 4, Normals < 2, no Sanger filter applied | 355 |
| 2 | 112308558 | 112337951 | 29393 | loss | 1908 | ANAPC1 | 11.92 | Exon + ve, ASD > 4, Normals < 2, no Sanger filter applied | 355 |
| 2 | 112308558 | 112337951 | 29393 | loss | 2005 | ANAPC1 | 11.92 | Exon + ve, ASD > 4, Normals < 2, no Sanger filter applied | 355 |
| 2 | 112745189 | 112764889 | 19700 | loss | 1905 | ZC3H6 | 7.42 | Intron + ve, ASD > 4, Normals < 2, no Sanger filter applied | 555 |
| 2 | 112752277 | 112764889 | 12612 | gain | 1266 | ZC3H6 | 7.42 | Intron + ve, ASD > 4, Normals < 2, no Sanger filter applied | 552 |
| 2 | 112752277 | 112764889 | 12612 | gain | 1653 | ZC3H6 | 7.42 | Intron + ve, ASD > 4, Normals < 2, no Sanger filter applied | 532 |
| 2 | 112752277 | 112764889 | 12612 | gain | 1694 | ZC3H6 | 7.42 | Intron + ve, ASD > 4, Normals < 2, no Sanger filter applied | 554 |
| 2 | 112752277 | 112764889 | 12612 | gain | 1910 | ZC3H6 | 7.42 | Intron + ve, ASD > 4, Normals < 2, no Sanger filter applied | 532 |
| 2 | 113215024 | 113216275 | 1251 | loss | 1249 | CKAP2L | 4.44 | Exon + ve, 5 > ASD > 1, Normals < 2, Sanger – ve | 676 |
| 2 | 113215024 | 113216275 | 1251 | loss | 1265 | CKAP2L | 4.44 | Exon + ve, 5 > ASD > 1, Normals < 2, Sanger – ve | 211 |
| 2 | 113215024 | 113216275 | 1251 | loss | 1306 | CKAP2L | 4.44 | Exon + ve, 5 > ASD > 1, Normals < 2, Sanger – ve | 676 |
| 2 | 115483979 | 115504398 | 20419 | loss | 1798 | DPP10 | 28.77 | Intron + ve, ASD > 4, Normals < 2, no Sanger filter applied | 213 |
| 2 | 115492911 | 115504398 | 11487 | loss | 1293 | DPP10 | 28.77 | Intron + ve, ASD > 4, Normals < 2, no Sanger filter applied | 211 |
| 2 | 115492911 | 115504398 | 11487 | loss | 1298 | DPP10 | 28.77 | Intron + ve, ASD > 4, Normals < 2, no Sanger filter applied | 211 |
| 2 | 115492911 | 115495165 | 252 | loss | 1720 | DPP10 | 28.77 | Intron + ve, ASD > 4, Normals < 2, no Sanger filter applied | 212 |
| 2 | 115492911 | 115493163 | 252 | loss | 1723 | DPP10 | 28.77 | Intron + ve, ASD > 4, Normals < 2, no Sanger filter applied | 212 |
| 2 | 115492911 | 115493163 | 352 | loss | 1837 | DPP10 | 28.77 | Intron + ve, ASD > 4, Normals < 2, no Sanger filter applied | 212 |
| 2 | 115492911 | 115504398 | 11487 | loss | 1855 | DPP10 | 28.77 | Intron + ve, ASD > 4, Normals < 2, no Sanger filter applied | 211 |
| 2 | 115492911 | 115493163 | 252 | loss | 1916 | DPP10 | 28.77 | Intron + ve, ASD > 4, Normals < 2, no Sanger filter applied | 212 |
| 2 | 115492911 | 115493163 | 252 | loss | 1935 | DPP10 | 28.77 | Intron + ve, ASD > 4, Normals < 2, no Sanger filter applied | 212 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 2 | 115492911 | 115493163 | 252 | loss | 1942 | DPP10 | 28.77 | Intron + ve, ASD > 4, Normals < 2, no Sanger filter applied | 212 |
| 2 | 115492911 | 115493163 | 252 | loss | 1946 | DPP10 | 28.77 | Intron + ve, ASD > 4, Normals < 2, no Sanger filter applied | 212 |
| 2 | 115492911 | 115493163 | 252 | loss | 1952 | DPP10 | 28.77 | Intron + ve, ASD > 4, Normals < 2, no Sanger filter applied | 212 |
| 2 | 115492911 | 115493165 | 252 | loss | 1953 | DPP10 | 28.77 | Intron + ve, ASD > 4, Normals < 2, no Sanger filter applied | 212 |
| 2 | 115492911 | 115493163 | 252 | loss | 1958 | DPP10 | 28.77 | Intron + ve, ASD > 4, Normals < 2, no Sanger filter applied | 212 |
| 2 | 115492911 | 115493163 | 252 | loss | 1960 | DPP10 | 28.77 | Intron + ve, ASD > 4, Normals < 2, no Sanger filter applied | 212 |
| 2 | 115492911 | 115493165 | 252 | loss | 1963 | DPP10 | 28.77 | Intron + ve, ASD > 4, Normals < 2, no Sanger filter applied | 212 |
| 2 | 115492911 | 115493163 | 252 | loss | 1965 | DPP10 | 28.77 | Intron + ve, ASD > 4, Normals < 2, no Sanger filter applied | 212 |
| 2 | 115492911 | 115493163 | 252 | loss | 1966 | DPP10 | 28.77 | Intron + ve, ASD > 4, Normals < 2, no Sanger filter applied | 212 |
| 2 | 115492911 | 115493163 | 252 | loss | 1969 | DPP10 | 28.77 | Intron + ve, ASD > 4, Normals < 2, no Sanger filter applied | 212 |
| 2 | 120359909 | 120361151 | 1242 | gain | 1224 | PTPN4 | 2.95 | Exon + ve, 5 > ASD > 1, Normals < 2, Sanger − ve | 751 |
| 2 | 120359909 | 120361151 | 1242 | gain | 1942 | PTPN4 | 2.95 | Exon + ve, 5 > ASD > 1, Normals < 2, Sanger − ve | 751 |
| 2 | 131921816 | 131976434 | 54618 | loss | 1224 | LOC150776, TUBA3D, MZT2A | 13.43 | Exon + ve, ASD > 4, Normals < 2, no Sanger filter applied | 323 |
| 2 | 131921816 | 131976434 | 54618 | loss | 1295 | LOC150776, TUBA3D, MZT2A | 13.43 | Exon + ve, ASD > 4, Normals < 2, no Sanger filter applied | 323 |
| 2 | 131921816 | 131976434 | 54618 | loss | 1301 | LOC150776, TUBA3D, MZT2A | 13.43 | Exon + ve, ASD > 4, Normals < 2, no Sanger filter applied | 323 |
| 2 | 131921816 | 131976434 | 54618 | loss | 1404 | LOC150776, TUBA3D, MZT2A | 13.43 | Exon + ve, ASD > 4, Normals < 2, no Sanger filter applied | 323 |
| 2 | 131921816 | 131976434 | 54618 | loss | 1492 | LOC150776, TUBA3D, MZT2A | 13.43 | Exon + ve, ASD > 4, Normals < 2, no Sanger filter applied | 323 |
| 2 | 131921816 | 131982998 | 61182 | loss | 1742 | LOC150776, TUBA3D, MZT2A | 13.43 | Exon + ve, ASD > 4, Normals < 2, no Sanger filter applied | 324 |
| 2 | 131921816 | 131976434 | 54618 | loss | 1896 | LOC150776, TUBA3D, MZT2A | 13.43 | Exon + ve, ASD > 4, Normals < 2, no Sanger filter applied | 323 |
| 2 | 131921816 | 131976434 | 54618 | loss | 1900 | LOC150776, TUBA3D, MZT2A | 13.43 | Exon + ve, ASD > 4, Normals < 2, no Sanger filter applied | 323 |
| 2 | 131921816 | 131976434 | 54618 | loss | 1917 | LOC150776, TUBA3D, MZT2A | 15.45 | Exon + ve, ASD > 4, Normals < 2, no Sanger filter applied | 525 |
| 2 | 140701510 | 140702990 | 1480 | gain | 1237 | | 33.47 | high OR intergenic (OR > 30) | 190 |
| 2 | 140701510 | 140702990 | 1480 | gain | 1240 | | 33.47 | high OR intergenic (OR > 30) | 190 |
| 2 | 140701510 | 140702990 | 1480 | gain | 1272 | | 33.47 | high OR intergenic (OR > 30) | 190 |
| 2 | 140701510 | 140702990 | 1486 | gain | 1343 | | 33.47 | high OR intergenic (OR > 30) | 190 |
| 2 | 140701510 | 140702990 | 1480 | gain | 1432 | | 33.47 | high OR intergenic (OR > 30) | 190 |
| 2 | 140701510 | 140702990 | 1486 | gain | 1501 | | 33.47 | high OR intergenic (OR > 30) | 190 |
| 2 | 140701510 | 140702990 | 1480 | gain | 1601 | | 33.47 | high OR intergenic (OR > 30) | 190 |
| 2 | 140701510 | 140702990 | 1486 | gain | 1616 | | 33.47 | high OR intergenic (OR > 30) | 190 |
| 2 | 140701510 | 140702990 | 1480 | gain | 1617 | | 33.47 | high OR intergenic (OR > 30) | 190 |
| 2 | 140701510 | 140702990 | 1480 | gain | 1618 | | 33.47 | high OR intergenic (OR > 30) | 190 |
| 2 | 140701510 | 140702990 | 1480 | gain | 1620 | | 33.47 | high OR intergenic (OR > 30) | 190 |
| 2 | 140701510 | 140702990 | 1480 | gain | 1629 | | 33.47 | high OR intergenic (OR > 30) | 190 |
| 2 | 140701510 | 140702990 | 1480 | gain | 1642 | | 33.47 | high OR intergenic (OR > 30) | 190 |
| 2 | 140701510 | 140702990 | 1480 | gain | 1645 | | 33.47 | high OR intergenic (OR > 30) | 190 |
| 2 | 140701510 | 140702990 | 1480 | gain | 1672 | | 33.47 | high OR intergenic (OR > 30) | 190 |
| 2 | 140701510 | 140702990 | 1480 | gain | 1865 | | 35.47 | high OR intergenic (OR > 30) | 190 |
| 2 | 110701510 | 140702990 | 1480 | gain | 1900 | | 33.47 | high OR intergenic (OR > 30) | 190 |
| 2 | 140701510 | 140702990 | 1480 | gain | 1904 | | 33.47 | high OR intergenic (OR > 30) | 190 |
| 2 | 140701510 | 140702990 | 1480 | gain | 1949 | | 33.47 | high OR intergenic (OR > 30) | 190 |
| 2 | 140701510 | 140702990 | 1480 | gain | 1999 | | 33.47 | high OR intergenic (OR > 30) | 190 |
| 2 | 140701510 | 140702990 | 1480 | gain | 2031 | | 33.47 | high OR intergenic (OR > 30) | 190 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 2 | 140701510 | 140702990 | 1480 | gain | 2034 | | 33.47 | high OR intergenic (OR > 30) | 190 |
| 2 | 150020572 | 150022009 | 1637 | gain | 1281 | LYPD6 | 11.92 | Intron + ve, ASD > 4, Normals < 2, no Sanger filter applied | 357 |
| 2 | 150020372 | 150022009 | 1637 | gain | 1389 | LYPD6 | 11.92 | Intron + ve, ASD > 4, Normals < 2, no Sanger filter applied | 357 |
| 2 | 150020372 | 150022009 | 1637 | gain | 1391 | LYPD6 | 11.92 | Intron + ve, ASD > 4, Normals < 2, no Sanger filter applied | 357 |
| 2 | 150020372 | 150022009 | 1637 | gain | 1411 | LYPD6 | 11.92 | Intron + ve, ASD > 4, Normals < 2, no Sanger filter applied | 357 |
| 2 | 150020372 | 150022009 | 1637 | gain | 1434 | LYPD6 | 11.92 | Intron + ve, ASD > 4, Normals < 2, no Sanger filter applied | 357 |
| 2 | 150020372 | 150022009 | 1637 | gain | 1435 | LYPD6 | 11.92 | Intron + ve, ASD > 4, Normals < 2, no Sanger filter applied | 357 |
| 2 | 150020372 | 150022009 | 1637 | gain | 1449 | LYPD6 | 11.92 | Intron + ve, ASD > 4, Normals < 2, no Sanger filter applied | 357 |
| 2 | 150020372 | 150022009 | 1637 | gain | 1654 | LYPD6 | 11.92 | Intron + ve, ASD > 4, Normals < 2, no Sanger filter applied | 357 |
| 2 | 165652444 | 165654598 | 2154 | loss | 1484 | SCN3A | 2.95 | Exon + ve- 5 > ASD > 1, Normals < 2, Sanger − ve | 752 |
| 2 | 165652444 | 165654598 | 2154 | loss | 1873 | SCN3A | 2.95 | Exon + ve, 5 > ASD > 1, Normals < 2, Sanger − ve | 752 |
| 2 | 178545984 | 178556781 | 10797 | loss | 1949 | PDE11A | 7.42 | Intron + ve, ASD > 4, Normals < 2, no Sanger filter applied | 536 |
| 2 | 178552260 | 178567628 | 15368 | loss | 1410 | PDE11A | 7.42 | Intron + ve, ASD > 4, Normals < 2, no Sanger filter applied | 534 |
| 2 | 178552260 | 178558860 | 6600 | loss | 1500 | PDE11A | 7.42 | Intron + ve, ASD > 4, Normals < 2, no Sanger filter applied | 535 |
| 2 | 178552260 | 178558860 | 6600 | loss | 1505 | PDE11A | 7.42 | Intron + ve, ASD > 4, Normals < 2, no Sanger filter applied | 535 |
| 2 | 178552260 | 178567628 | 15368 | loss | 1811 | PDE11A | 7.42 | Intron + ve, ASD > 4, Normals < 2, no Sanger filter applied | 534 |
| 2 | 197607589 | 197612724 | 5135 | loss | 1281 | ANKRD44 | 14.83 | Genic (distinct CNV-subregions); OR > 6 | 306 |
| 2 | 197883024 | 197884226 | 1202 | loss | 1299 | ANKRD44 | 14.83 | Genic (distinct CNV-subreaions); OR > 6 | 307 |
| 2 | 197883024 | 197884226 | 1202 | loss | 1391 | ANKRD44 | 14.83 | Genic (distinct CNV-subregions); OR > 6 | 307 |
| 2 | 197883024 | 197884226 | 1202 | gain | 1448 | ANKRD44 | 14.83 | Genic (distinct CNV-subregions); OR > 6 | 307 |
| 2 | 197883024 | 197884226 | 1202 | loss | 1465 | ANKRD44 | 14.83 | Genic (distinct CNV-subregions); OR > 6 | 307 |
| 2 | 197883024 | 197884226 | 1202 | loss | 1477 | ANKRD44 | 14.83 | Cienic (distinct CNV-subregions); OR > 6 | 307 |
| 2 | 197883024 | 197884226 | 1202 | loss | 1548 | ANKRD44 | 14.83 | Genic (distinct CNV-subregions); OR > 6 | 307 |
| 2 | 197883024 | 197884226 | 1202 | loss | 1559 | ANKRD44 | 14.83 | Genic (distinct CNV-subregions); OR > 6 | 307 |
| 2 | 197883024 | 197884226 | 1202 | loss | 1566 | ANKRD44 | 14.83 | Genic (distinct CNV-subregions); OR > 6 | 307 |
| 2 | 197883024 | 197884226 | 1202 | loss | 1580 | ANKRD44 | 14.83 | Genic (distinct CNV-subregions); OR > 6 | 507 |
| 2 | 197883024 | 197884226 | 1202 | gain | 1597 | ANKRD44 | 14.83 | Genic (distinct CNV-subregions); OR > 6 | 307 |
| 2 | 197883024 | 197884226 | 1202 | loss | 1609 | ANKRD44 | 14.83 | Genic (distinct CNV-subregions); OR > 6 | 307 |
| 2 | 197883024 | 197884226 | 1202 | loss | 1629 | ANKRD44 | 14.83 | Genic (distinct CNV-subregions); OR > 6 | 308 |
| 2 | 197926527 | 197884226 | 43503 | gain | 1644 | ANKRD44 | 14.83 | Genic (distinct CNV-subregions); OR > 6 | 307 |
| 2 | 197883024 | 197884226 | 1202 | loss | 1699 | ANKRD44 | 14.83 | Genic (distinct CNV-subregions); OR > 6 | 307 |
| 2 | 197883024 | 197884226 | 1202 | loss | 1704 | ANKRD44 | 14.83 | Genic (distinct CNV-subregions); OR > 6 | 307 |
| 2 | 197883024 | 197884226 | 1202 | loss | 1724 | ANKRD44 | 14.83 | Genic (distinct CNV-subregions); OR > 6 | 307 |
| 2 | 197883024 | 197884226 | 1202 | loss | 1743 | ANKRD44 | 14.83 | Genic (distinct CNV-subregions); OR > 6 | 307 |
| 2 | 197883024 | 197884226 | 1202 | gain | 1830 | ANKRD44 | 14.83 | Genic (distinct CNV-subregions); OR > 6 | 307 |
| 2 | 197883024 | 197884226 | 1202 | loss | 1844 | ANKRD44 | 14.83 | Genic (distinct CNV-subregions); OR > 6 | 307 |
| 2 | 197883024 | 197884226 | 1202 | loss | 1869 | ANKRD44 | 14.83 | Genic (distinct CNV-subregions); OR > 6 | 307 |
| 2 | 197883024 | 197884226 | 1202 | loss | 1905 | ANKRD44 | 14.83 | Genic (distinct CNV-subregions); OR > 6 | 307 |
| 2 | 197883024 | 197884226 | 1202 | loss | 1921 | ANKRD44 | 14.83 | Genic (distinct CNV-subregions); OR > 6 | 307 |
| 2 | 197883024 | 197884226 | 1202 | loss | 1952 | ANKRD44 | 14.83 | Genic (distinct CNV-subresions); OR > 6 | 307 |
| 2 | 197883024 | 197884226 | 1202 | loss | 1959 | ANKRD44 | 14.83 | Genic (distinct CNV-subregions); OR > 6 | 307 |
| 2 | 197883024 | 197884226 | 1202 | loss | 1962 | ANKRD44 | 14.83 | Genic (distinct CNV-subregions); OR > 6 | 307 |
| 2 | 197883024 | 197884226 | 1202 | loss | 1964 | ANKRD44 | 14.83 | Genic (distinct CNV-subregions); OR > 6 | 307 |
| 2 | 197883024 | 197884226 | 1202 | loss | 2031 | ANKRD44 | 14.83 | Genic (distinct CNV-subregions); OR > 6 | 307 |
| 2 | 197883024 | 197884226 | 1202 | loss | 2035 | ANKRD44 | 14.83 | Genic (distinct CNV subrcsions); OR > 6 | 307 |
| 2 | 213922938 | 213938010 | 15072 | loss | 1870 | SPAG16 | 7.42 | Intron + ve, ASD > 4, Normals < 2, no Sanger filter applied | 538 |
| 2 | 213932902 | 213933569 | 667 | loss | 1386 | SPAG16 | 7.42 | Intron + ve, ASD > 4, Normals < 2, no Sanger filter applied | 537 |
| 2 | 213932902 | 213933569 | 667 | loss | 1500 | SPAG16 | 7.42 | Intron + ve, ASD > 4, Normals < 2, no Sanger filter applied | 537 |
| 2 | 213932902 | 213933569 | 667 | loss | 1583 | SPAG16 | 7.42 | Intron + ve, ASD > 4, Normals < 2, no Sanger filter applied | 537 |
| 2 | 213932902 | 213933569 | 667 | loss | 1912 | SPAG16 | 7.42 | Intron + ve, ASD > 4, Normals < 2, no Sanger filter applied | 537 |
| 2 | 215367912 | 215378790 | 10878 | gain | 1370 | BARD1 | 4.44 | Exon + ve, 5 > ASD > 1, Normals < 2, Sanger − ve | 677 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 2 | 215367912 | 215378790 | 10878 | gain | 1604 | BARD1 | 4.44 | Exon + ve, 5 > ASD > 1, Normals < 2, Sanger – ve | 677 |
| 2 | 215367912 | 215378790 | 10878 | gain | 1925 | BARD1 | 4.44 | Exon t ve, 5 > ASD > 1, Normals < 2, Sanger – ve | 677 |
| 3 | 76072 | 406838 | 330766 | gain | 1598 | CHL1 | 4.44 | Exon t ve, 5 > ASD > 1, Normals < 2, Sanger – ve | 679 |
| 3 | 76072 | 406838 | 330766 | gain | 1598 | CHL1 | 2.95 | Exon + ve, 5 > ASD > 1, Normals < 2, Sanger – ve | 679 |
| 3 | 227364 | 1488979 | 1261615 | gain | 1657 | CHL1 | 4.44 | Exon + ve, 5 > ASD > 1, Normals < 2, Sanger – ve | 680 |
| 3 | 227364 | 1488979 | 1261615 | gain | 1657 | CHL1 | 2.95 | Exon + ve, 5 > ASD > 1, Normals < 2, Sanger – ve | 680 |
| 3 | 310349 | 353620 | 43271 | gain | 1273 | CHL1 | 4.44 | Exon + ve, 5 > ASD > 1, Normals < 2, Sanger – ve | 678 |
| 3 | 2389001 | 2955718 | 566717 | gain | 1851 | CNTN4 | 2.95 | Exon + ve, 5 > ASD > 1, Normals < 2, Sanger – ve | 754 |
| 3 | 2747805 | 2834416 | 86611 | gain | 1595 | CNTN4 | 2.95 | Exon + ve, 5 > ASD > 1, Normals < 2, Sanger – ve | 753 |
| 3 | 15114373 | 16536184 | 1421811 | loss | 1850 | HACL1 | 2.95 | Exon + ve, 5 > ASD > 1, Normals < 2, Sanger – ve | 756 |
| 3 | 15587405 | 15593664 | 6259 | loss | 1564 | HACL1 | 2.95 | Exon + ve, 5 > ASD > 1, Normals < 2, Sanger – ve | 755 |
| 3 | 29370672 | 29380899 | 10227 | loss | 1442 | RBMS3 | 10.41 | Intron + ve, ASD > 4, Normals < 2, no Sanger filter applied | 393 |
| 3 | 29370672 | 29380899 | 10227 | loss | 1475 | RBMS3 | 10.41 | Intron + ve, ASD > 4, Normals < 2, no Sanger filter applied | 393 |
| 3 | 29370672 | 29380899 | 10227 | loss | 1500 | RBMS3 | 10.41 | Intron + ve, ASD > 4, Normals < 2, no Sanger filter applied | 393 |
| 3 | 29370672 | 29380899 | 10227 | loss | 1567 | RBMS3 | 10.41 | Intron + ve, ASD > 4, Normals < 2, no Sanger filter applied | 393 |
| 3 | 29370672 | 29380899 | 10227 | loss | 1442 | RBMS3 | 7.42 | Intron + ve, ASD > 4, Normals < 2, no Sanger filter applied | 393 |
| 3 | 29370672 | 29380899 | 10227 | loss | 1475 | RBMS3 | 7.42 | Intron + ve, ASD > 4, Normals < 2, no Sanger filter applied | 393 |
| 3 | 29370672 | 29380899 | 10227 | loss | 1500 | RBMS3 | 7.42 | Intron + ve, ASD > 4, Normals < 2, no Sanger filter applied | 393 |
| 3 | 29370672 | 29380899 | 10227 | loss | 1567 | RBMS3 | 7.42 | Intron + ve, ASD > 4, Normals < 2, no Sanger filter applied | 393 |
| 3 | 29373456 | 29379164 | 5708 | loss | 1324 | RBMS3 | 10.41 | Intron + ve, ASD > 4, Normals < 2, no Sanger filter applied | 392 |
| 3 | 29373456 | 29379164 | 5708 | loss | 1568 | RBMS3 | 10.41 | Intron + ve, ASD > 4, Normals < 2, no Sanger filter applied | 392 |
| 3 | 29373456 | 29379164 | 5708 | loss | 1585 | RBMS3 | 10.41 | Intron + ve, ASD > 4, Normals < 2, no Sanger filter applied | 392 |
| 3 | 29379164 | 29380899 | 1735 | loss | 1425 | RBMS3 | 7.42 | Intron + ve, ASD > 4, Normals < 2, no Sanger filter applied | 539 |
| 3 | 32285101 | 32285133 | 32 | gain | 1233 | CMTM8 | 11.92 | Intron + ve, ASD > 4, Normals < 2, no Sanger filter applied | 358 |
| 3 | 32290376 | 32285133 | 5275 | gain | 1282 | CMTM8 | 11.92 | Intron + ve, ASD > 4, Normals < 2, no Sanger filter applied | 359 |
| 3 | 32285101 | 32285133 | 32 | gain | 1419 | CMTM8 | 11.92 | Intron + ve, ASD > 4, Normals < 2, no Sanger filter applied | 358 |
| 3 | 32285101 | 32285133 | 32 | gain | 1452 | CMTM8 | 11.92 | Intron + ve, ASD > 4, Normals < 2, no Sanger filter applied | 358 |
| 3 | 32285101 | 32285133 | 32 | gain | 1467 | CMTM8 | 11.92 | Intron + ve, ASD > 4, Normals < 2, no Sanger filter applied | 358 |
| 3 | 32285101 | 32285133 | 32 | gain | 1561 | CMTM8 | 11.92 | Intron + ve, ASD > 4, Normals < 2, no Sanger filter applied | 358 |
| 3 | 32285101 | 32285133 | 32 | gain | 1604 | CMTM8 | 11.92 | Intron + ve, ASD > 4, Normals < 2, no Sanger filter applied | 358 |
| 3 | 32285101 | 32285133 | 32 | gain | 2024 | CMTM8 | 11.92 | Intron + ve, ASD > 4, Normals < 2, no Sanger filter applied | 358 |
| 3 | 33868917 | 33873484 | 4567 | loss | 1259 | PDCD6IP | 7.42 | Intron + ve, ASD > 4, Normals < 2, no Sanger filter applied | 540 |
| 3 | 33868917 | 33873484 | 4567 | loss | 1274 | PDCD6IP | 7.42 | Intron + ve, ASD > 4, Normals < 2, no Sanger filter applied | 540 |
| 3 | 33868917 | 33873484 | 4567 | loss | 1724 | PDCD6IP | 7.42 | Intron + ve, ASD > 4, Normals < 2, no Sanger filter applied | 540 |
| 3 | 33871823 | 33873484 | 1661 | gain | 1602 | PDCD6IP | 7.42 | Intron + ve, ASD > 4, Normals < 2, no Sanger filter applied | 541 |
| 3 | 33871823 | 33873484 | 1661 | gain | 1926 | PDCD6IP | 7.42 | Intron + ve, ASD > 4, Normals < 2, no Sanger filter applied | 541 |
| 3 | 38415026 | 38433483 | 18457 | loss | 1725 | XYLB | 7.42 | Intron + ve, ASD > 4, Normals < 2, no Sanger filter applied | 543 |
| 3 | 38415026 | 38433483 | 18457 | loss | 1802 | XYLB | 7.42 | Intron + ve, ASD > 4, Normals < 2, no Sanger filter applied | 544 |
| 3 | 38415026 | 38433483 | 18457 | loss | 1725 | XYLB | 7.42 | Intron + ve, ASD > 4, Normals < 2, no Sanger filter applied | 545 |
| 3 | 38417568 | 38428090 | 10522 | loss | 1428 | XYLB | 2.95 | Exon + ve, 5 > ASD > 1, Normals < 2, Sanger – ve | 542 |
| 3 | 38417568 | 38428090 | 10522 | loss | 1848 | XYLB | 7.42 | Intron + ve, ASD > 4, Normals < 2, no Sanger filter applied | 542 |
| 3 | 38417568 | 38430518 | 12950 | gain | 1881 | XYLB | 7.42 | Intron + ve, ASD > 4, Normals < 2, no Sanger filter applied | 542 |
| 3 | 38417568 | 38430518 | 12950 | loss | 1881 | XYLB | 7.42 | Intron + ve, ASD > 1, Normals < 2, Sanger – ve | 545 |
| 3 | 42708033 | 42718285 | 10252 | loss | 1966 | HHATL | 7.42 | Exon + ve, ASD > 4, Normals < 2, no Sanger filter applied | 548 |
| 3 | 42708033 | 42718285 | 10252 | loss | 1966 | HHATL | 4.44 | Exon + ve, 5 > ASD > 1, Normals < 2, Sanger – ve | 548 |
| 3 | 42715137 | 42715137 | 1650 | loss | 1393 | HHATL | 7.42 | Exon + ve, ASD > 4, Normals < 2, no Sanger filter applied | 546 |
| 3 | 42715137 | 42715137 | 1650 | loss | 1620 | HHATL | 7.42 | Exon + ve, ASD > 4, Normals < 2, no Sanger filter applied | 546 |
| 3 | 42713487 | 42718285 | 4798 | loss | 1776 | HHATL | 7.42 | Exon + ve, ASD > 4, Normals < 2, no Sanger filter applied | 547 |
| 3 | 42713487 | 42718285 | 4798 | loss | 1806 | HHATL | 7.42 | Exon + ve, ASD > 4, Normals < 2, no Sanger filter applied | 547 |
| 3 | 42713487 | 42718285 | 4798 | loss | 1776 | HHATL | 4.44 | Exon + ve, 5 > ASD > 1, Normals < 2, Sanger – ve | 547 |
| 3 | 42713487 | 42718285 | 4798 | loss | 1806 | HHATL | 4.44 | Exon + ve, 5 > ASD > 1, Normals < 2, Sanger – ve | 547 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 3 | 45218616 | 45264751 | 46135 | gain | 1514 | TMEM158 | 2.95 | Exon + ve, 5 > ASD > 1, Normals < 2, Sanger – ve | 757 |
| 3 | 45218616 | 45264751 | 46135 | gain | 1874 | TMEM158 | 2.95 | Exon + ve, 5 > ASD > 1, Normals < 2, Sanger – ve | 757 |
| 3 | 50166741 | 50184719 | 17978 | loss | 1965 | SEMA3F | 7.46 | Genic (distinct CNV-subreaions); OR > 6 | 521 |
| 3 | 50166741 | 50184719 | 17978 | loss | 1965 | SEMA3F | 7.46 | Genic (distinct CNV-subreaions); OR > 6 | 521 |
| 3 | 50166741 | 50184719 | 17978 | loss | 1965 | SEMA3F | 7.46 | Genic (distinct CNV-subreaions); OR > 6 | 521 |
| 3 | 50171930 | 50173645 | 1715 | loss | 1548 | SEMA3F | 7.46 | Genic (distinct CNV-subreaions); OR > 6 | 522 |
| 3 | 50171930 | 50174341 | 2411 | loss | 1727 | SEMA3F | 7.46 | Genic (distinct CNV-subreaions); OR > 6 | 523 |
| 3 | 50171930 | 50174341 | 2411 | loss | 1739 | SEMA3F | 7.46 | Genic (distinct CNV-subreaions); OR > 6 | 523 |
| 3 | 50173645 | 50174341 | 696 | loss | 1739 | SEMA3F | 7.46 | Genic (distinct CNV-subreaions); OR > 6 | 524 |
| 3 | 50173645 | 50174341 | 696 | loss | 1232 | SEMA3F | 7.46 | Genic (distinct CNV-subreaions); OR > 6 | 524 |
| 3 | 50173645 | 50174341 | 696 | loss | 1299 | SEMA3F | 7.46 | Genic (distinct CNV-subreaions); OR > 6 | 524 |
| 3 | 50173645 | 50174341 | 696 | loss | 1697 | SEMA3F | 7.46 | Genic (distinct CNV-subreaions); OR > 6 | 524 |
| 3 | 50173645 | 50174341 | 696 | loss | 1737 | SEMA3F | 7.46 | Genic (distinct CNV-subreaions); OR > 6 | 524 |
| 3 | 50173645 | 50174341 | 696 | loss | 1868 | SFMA3F | 7.46 | Genic (distinct CNV-subreaions); OR > 6 | 524 |
| 3 | 50173645 | 50174341 | 696 | loss | 1958 | SFMA3F | 7.46 | Genic (distinct CNV-subreaions); OR > 6 | 524 |
| 3 | 52997045 | 53011885 | 14840 | loss | 1515 | SFMBT1 | 7.42 | Intron + ve, ASD > 4, Normals < 2, no Sanger filter applied | 242 |
| 3 | 52997045 | 53006923 | 9878 | loss | 1576 | SFMBT1 | 7.42 | Intron + ve, ASD > 4, Normals < 2, no Sanger filter applied | 243 |
| 3 | 52997045 | 53011885 | 14840 | loss | 1515 | SFMBT1 | 19.51 | Intron + ve, ASD > 4, Normals < 2, no Sanger filter applied | 242 |
| 3 | 52997045 | 53006923 | 9878 | loss | 1576 | SFMBT1 | 19.51 | Intron ve, ASD > 4, Normals < 2, no Sanger filter applied | 243 |
| 3 | 52999601 | 53011885 | 12284 | loss | 1343 | SFMBT1 | 7.42 | Intron + ve, ASD > 4, Normals < 2, no Sanger filter applied | 240 |
| 3 | 52999601 | 53011885 | 12284 | loss | 1568 | SFMBT1 | 7.42 | Intron + ve, ASD > 4, Normals < 2, no Sanger filter applied | 240 |
| 3 | 52999601 | 53011885 | 12284 | loss | 1587 | SFMBT1 | 7.42 | Intron + ve, ASD > 4, Normals < 2, no Sanger filter applied | 240 |
| 3 | 52999601 | 53011885 | 12284 | loss | 1343 | SFMBT1 | 19.51 | Intron + ve, ASD > 4, Normals < 2, no Sanger filter applied | 240 |
| 3 | 52999601 | 53011885 | 12284 | loss | 1568 | SFMBT1 | 19.51 | Intron + ve, ASD > 4, Normals < 2, no Sanger filter applied | 240 |
| 3 | 52999601 | 53011885 | 12284 | loss | 1587 | SFMBT1 | 19.51 | Intron + ve, ASD > 4, Normals < 2, no Sanger filter applied | 240 |
| 3 | 53001678 | 53011885 | 10267 | loss | 1236 | SFMBT1 | 19.51 | Intron + ve, ASD > 4, Normals < 2, no Sanger filter applied | 239 |
| 3 | 53001678 | 53011885 | 10207 | loss | 1272 | SFMBT1 | 19.51 | Intron + ve, ASD > 4, Normals < 2, no Sanger filter applied | 239 |
| 3 | 53001678 | 53011885 | 10207 | loss | 1277 | SFMBT1 | 19.51 | Intron + ve, ASD > 4, Normals < 2, no Sanger filter applied | 259 |
| 3 | 53001678 | 53020109 | 18431 | loss | 1494 | SFMBT1 | 19.51 | Intron + ve, ASD > 4, Normals < 2, no Sanger filter applied | 241 |
| 3 | 53001678 | 53011885 | 10207 | loss | 1605 | SFMBT1 | 19.51 | Intron + ve, ASD > 4, Normals < 2, no Sanger filter applied | 239 |
| 3 | 53001678 | 53011885 | 10207 | loss | 1705 | SFMBT1 | 19.51 | Intron + ve, ASD > 4, Normals < 2, no Sanger filter applied | 239 |
| 3 | 53001678 | 53011885 | 10207 | loss | 1744 | SFMBT1 | 19.51 | Intron + ve, ASD > 4, Normals < 2, no Sanger filter applied | 239 |
| 3 | 53001678 | 53011885 | 10207 | loss | 1792 | SFMBT1 | 19.51 | Intron + ve, ASD > 4, Normals < 2, no Sanger filter applied | 239 |
| 3 | 53001678 | 53020109 | 18431 | loss | 1494 | SFMBT1 | 7.42 | Intron + ve, ASD > 4, Normals < 2, no Sanger filter applied | 241 |
| 3 | 53003136 | 53014254 | 11118 | loss | 1347 | SFMBT1 | 8.91 | Intron + ve, ASD > 4, Normals < 2, no Sanger filter applied | 519 |
| 3 | 53005156 | 53020109 | 16975 | loss | 1426 | SFMBT1 | 8.91 | Intron + ve, ASD > 4, Normals < 2, no Sanger filter applied | 550 |
| 3 | 53003136 | 53020109 | 16973 | loss | 1441 | SFMBT1 | 8.91 | Intron + ve, ASD > 4, Normals < 2, no Sanger filter applied | 550 |
| 3 | 53003136 | 53020109 | 16973 | loss | 1784 | SFMBT1 | 8.91 | Intron + ve, ASD > 4, Normals < 2, no Sanger filter applied | 550 |
| 3 | 56883582 | 56894585 | 11003 | loss | 1117 | CCDC66 | 8.91 | Intron + ve, ASD > 1, Normals < 2, no Sanger filter applied | 445 |
| 3 | 56883582 | 56894585 | 11003 | loss | 1436 | CCDC66 | 8.91 | Intron + ve, ASD > 4, Normals < 2, no Sanger filter applied | 443 |
| 3 | 56883582 | 56894585 | 11003 | loss | 1618 | CCDC66 | 8.91 | Intron + ve, ASD > 4, Normals < 2, no Sanger filter applied | 443 |
| 3 | 56883582 | 56891797 | 8215 | loss | 1794 | CCDC66 | 8.91 | Intron + ve, ASD > 4, Normals < 2, no Sanger filter applied | 444 |
| 3 | 56883582 | 56894585 | 11003 | loss | 1901 | CCDC66 | 8.91 | Intron + ve, ASD > 4, Normals < 2, no Sanger filter applied | 443 |
| 3 | 56883582 | 56894585 | 11003 | loss | 2024 | CCDC66 | 8.91 | Intron + ve, ASD > 4, Normals < 2, no Sanger filter applied | 443 |
| 3 | 56883582 | 56894585 | 11003 | loss | 1417 | CCDC66 | 7.42 | Intron + ve, ASD > 4, Normals < 2, no Sanger filter applied | 443 |
| 3 | 56883582 | 56894585 | 11003 | loss | 1436 | CCDC66 | 7.42 | Intron + ve, ASD > 4, Normals < 2, no Sanger filter applied | 443 |
| 3 | 56883582 | 56894585 | 11003 | loss | 1618 | CCDC66 | 7.42 | Intron + ve, ASD > 4, Normals < 2, no Sanger filter applied | 443 |
| 3 | 56883582 | 56894585 | 11003 | loss | 1901 | CCDC66 | 7.42 | Intron + ve, ASD > 4, Normals < 2, no Sanger filter applied | 443 |
| 3 | 56883582 | 56894585 | 11003 | loss | 2024 | CCDC66 | 7.42 | Intron + ve, ASD > 4, Normals < 2, no Sanger filter applied | 443 |
| 3 | 60636043 | 60968063 | 332020 | loss | 1660 | FHIT | 11.92 | Intron + ve, ASD > 4, Normals < 2, no Sanger filter applied | 361 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 3 | 60717895 | 60719263 | 1368 | gain | 1266 | FHIT | 11.92 | Intron + ve, ASD > 4, Normals < 2, no Sanger filter applied | 360 |
| 3 | 60717895 | 60719263 | 1368 | gain | 1274 | FHIT | 11.92 | Intron + ve, ASD > 4, Normals < 2, no Sanger filter applied | 360 |
| 3 | 60717895 | 60719263 | 1368 | gain | 1275 | FHIT | 11.92 | Intron + ve, ASD > 4, Normals < 2, no Sanger filter applied | 560 |
| 3 | 60717895 | 60719263 | 1368 | gain | 1389 | FHIT | 11.92 | Intron + ve, ASD > 4, Normals < 2, no Sanger filter applied | 560 |
| 3 | 60717895 | 60719263 | 1368 | gain | 1606 | FHIT | 11.92 | Intron + ve, ASD > 4, Normals < 2, no Sanger filter applied | 560 |
| 3 | 60717895 | 60719263 | 1368 | gain | 1611 | FHIT | 11.92 | Intron + ve, ASD > 4, Normals < 2, no Sanger filter applied | 360 |
| 3 | 60717895 | 60719263 | 1368 | gain | 1884 | FHIT | 11.92 | Intron + ve, ASD > 4, Normals < 2, no Sanger filter applied | 360 |
| 3 | 65250214 | 70625658 | 5375444 | loss | 1680 | SUCLG2 | 7.42 | Intron + ve, ASD > 4, Normals < 2, no Sanger filter applied | 552 |
| 3 | 67446879 | 67748167 | 1288 | loss | 1673 | SUCLG2 | 7.42 | Intron + ve, ASD > 4, Normals < 2, no Sanger filter applied | 551 |
| 3 | 67446879 | 67750163 | 3284 | loss | 1748 | SUCLG2 | 7.42 | Intron + ve, ASD > 4, Normals < 2, no Sanger filter applied | 553 |
| 3 | 67446879 | 67748167 | 1288 | loss | 1940 | SUCLG2 | 7.42 | Intron + ve, ASD > 4, Normals < 2, no Sanger filter applied | 551 |
| 3 | 67446879 | 67748167 | 1288 | loss | 1953 | SUCLG2 | 7.42 | Intron + ve, ASD > 4, Normals < 2, no Sanger filter applied | 551 |
| 3 | 117168477 | 117172945 | 4468 | loss | 1434 | LSAMP | 13.43 | Intron + ve, ASD > 4, Normals < 2, no Sanger filter applied | 325 |
| 3 | 117168477 | 117174471 | 5994 | loss | 1723 | LSAMP | 13.43 | Intron + ve, ASD > 4, Normals < 2, no Sanger filter applied | 326 |
| 3 | 117168477 | 117174471 | 5994 | loss | 1916 | LSAMP | 13.43 | Intron + ve, ASD > 4, Normals < 2, no Sanger filter applied | 326 |
| 3 | 117168477 | 117170906 | 2429 | loss | 1958 | LSAMP | 13.43 | Intron + ve, ASD > 4, Normals < 2, no Sanger filter applied | 327 |
| 3 | 117168477 | 117170906 | 2429 | loss | 1961 | LSAMP | 15.43 | Intron + ve, ASD > 4, Normals < 2, no Sanger filter applied | 327 |
| 3 | 117168477 | 117170906 | 2429 | loss | 1963 | LSAMP | 13.43 | Intron + ve, ASD > 4, Normals < 2, no Sanger filter applied | 327 |
| 3 | 117168477 | 117170906 | 2429 | loss | 1966 | LSAMP | 13.43 | Intron + ve, ASD > 4, Normals < 2, no Sanger filter applied | 327 |
| 3 | 117168477 | 117170906 | 2429 | loss | 1967 | LSAMP | 13.43 | Intron + ve, ASD > 4, Normals < 2, no Sanger filter applied | 327 |
| 3 | 117168477 | 117170906 | 2429 | loss | 1969 | LSAMP | 13.43 | Intron + ve, ASD > 4, Normals < 2, no Sanger filter applied | 327 |
| 3 | 156826698 | 156832789 | 6091 | loss | 1224 | PLCH1 | 7.42 | Intron + ve, ASD > 4, Normals < 2, no Sanger filter applied | 554 |
| 3 | 156826698 | 156841384 | 14686 | loss | 1548 | PLCH1 | 7.42 | Intron + ve, ASD > 4, Normals < 2, no Sanger filter applied | 555 |
| 3 | 156826698 | 156834492 | 7794 | loss | 1707 | PLCH1 | 7.42 | Intron + ve, ASD > 4, Normals < 2, no Sanger filter applied | 556 |
| 3 | 156826698 | 156832789 | 6091 | loss | 1729 | PLCH1 | 7.42 | Intron + ve, ASD > 4, Normals < 2, no Sanger filter applied | 554 |
| 3 | 156826698 | 156832789 | 6091 | loss | 2023 | PLCH1 | 7.42 | Intron + ve, ASD > 4, Normals < 2, no Sanger filter applied | 554 |
| 3 | 168455955 | 168466714 | 10759 | gain | 1424 | ZBBX | 16.46 | Intron + ve, ASD > 4, Normals < 2, no Sanger filter applied | 280 |
| 3 | 168466681 | 168466714 | 33 | gain | 1394 | ZBBX | 16.46 | Intron + ve, ASD > 4, Normals < 2, no Sanger filter applied | 279 |
| 3 | 168466681 | 168466714 | 33 | gain | 1395 | ZBBX | 16.46 | Intron + ve, ASD > 4, Normals < 2, no Sanger filter applied | 279 |
| 3 | 168466681 | 168466714 | 33 | gain | 1396 | ZBBX | 16.46 | Intron + ve, ASD > 4, Normals < 2, no Sanger filter applied | 279 |
| 3 | 168466681 | 168466714 | 33 | gain | 1432 | ZBBX | 16.46 | Intron + ve, ASD > 4, Normals < 2, no Sanger filter applied | 279 |
| 3 | 168466681 | 168466714 | 33 | gain | 1570 | ZBBX | 16.46 | Intron + ve, ASD > 4, Normals < 2, no Sanger filter applied | 279 |
| 3 | 168466681 | 168466714 | 55 | gain | 1573 | ZBBX | 16.46 | Intron + ve, ASD > 4, Normals < 2, no Sanger filter applied | 279 |
| 3 | 168466681 | 168466714 | 55 | gain | 1620 | ZBBX | 16.46 | Intron + ve, ASD > 4, Normals < 2, no Sanger filter applied | 279 |
| 3 | 168466681 | 168482917 | 16236 | gain | 1865 | ZBBX | 16.46 | Intron + ve, ASD > 4, Normals < 2, no Sanger filter applied | 279 |
| 3 | 168466681 | 168466714 | 33 | gain | 1884 | ZBBX | 16.46 | Intron + ve, ASD > 4, Normals < 2, no Sanger filter applied | 279 |
| 3 | 168466681 | 168466714 | 33 | gain | 1908 | ZBBX | 16.46 | Intron + ve, ASD > 4, Normals < 2, no Sanger filter applied | 279 |
| 3 | 192544305 | 192552734 | 8429 | loss | 1251 | CCDC50 | 10.41 | Intron + ve, ASD > 4, Normals < 2, no Sanger filter applied | 394 |
| 3 | 192544305 | 192552734 | 8429 | loss | 1284 | CCDC50 | 10.41 | Intron + ve, ASD > 4, Normals < 2, no Sanger filter applied | 394 |
| 3 | 192544305 | 192552734 | 8429 | loss | 1401 | CCDC50 | 10.41 | Intron + ve, ASD > 4, Normals < 2, no Sanger filter applied | 394 |
| 3 | 192544305 | 192552734 | 8429 | loss | 1657 | CCDC50 | 10.41 | Intron + ve, ASD > 4, Normals < 2, no Sanger filter applied | 394 |
| 3 | 192544305 | 192552734 | 8429 | loss | 1697 | CCDC50 | 10.41 | Intron + ve, ASD > 4, Normals < 2, no Sanger filter applied | 394 |
| 3 | 192544305 | 192552734 | 8429 | loss | 1803 | CCDC50 | 10.41 | Intron + ve, ASD > 4, Normals < 2, no Sanger filter applied | 394 |
| 3 | 192544305 | 192552734 | 8429 | gain | 1884 | CCDC50 | 10.41 | Intron + ve, ASD > 4, Normals < 2, no Sanger filter applied | 304 |
| 3 | 197135314 | 197531031 | 395717 | gain | 1227 | ZDHHC19 | 2.95 | Exon + ve, 5 > ASD > 1, Normals > 1, Sanger − ve | 758 |
| 3 | 197135314 | 197531031 | 395717 | gain | 1227 | PCYT1A, TCTEX1D2 | 2.05 | Exon + ve, 5 > ASD > 1, Normals > 1, Sanger − ve | 758 |
| 3 | 197412253 | 197977900 | 565647 | gain | 1565 | ZDHHC19 | 2.95 | Exon + ve, 5 > ASD > 1, Normals > 1, Sanger − ve | 759 |
| 3 | 197412253 | 197977900 | 565647 | gain | 1565 | PCYT1A, TCTEX1D2 | 2.95 | Exon + ve, 5 > ASD > 1, Normals > 1, Sanger − ve | 759 |
| 4 | 68899247 | 69643272 | 744025 | gain | 1451 | UGT2B15,TMPRSS11E | 46.2 | Exon + ve, ASD > 4, Normals < 2, no Sanger filter applied | 05 |
| 4 | 68901210 | 69677857 | 776647 | gain | 1268 | UGT2B15,TMPRSS11E | 46.2 | Exon + ve, ASD > 4, Normals < 2, no Sanger filter applied | 91 |
| 4 | 68901210 | 60665979 | 761760 | gain | 1417 | UGT2B15,TMPRSS11E | 46.2 | Exon + ve, ASD > 4, Normals < 2, no Sanger filter applied | 93 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 4 | 68901210 | 69677857 | 776647 | gain | 1548 | UGT2B15,TMPRSS11E | 46.2 | Exon + ve, ASD > 4, Normals < 2, no Sanger filter applied | 91 |
| 4 | 68901210 | 69643272 | 742062 | gain | 1657 | UGT2B15,TMPRSS11E | 46.2 | Exon + ve, ASD > 4, Normals < 2, no Sanger filter applied | 97 |
| 4 | 68901210 | 69643272 | 742062 | gain | 1669 | UGT2B15,TMPRSS11E | 46.2 | Exon + ve, ASD > 4, Normals < 2, no Sanger filter applied | 97 |
| 4 | 69069651 | 69643272 | 573621 | gain | 1239 | UGT2B15,TMPRSS11E | 46.2 | Exon + ve, ASD > 4, Normals < 2, no Sanger filter applied | 90 |
| 4 | 69069651 | 69665979 | 596328 | gain | 1277 | UGT2B15,TMPRSS11E | 46.2 | Exon + ve, ASD > 4, Normals < 2, no Sanger filter applied | 92 |
| 4 | 69069651 | 69643272 | 573621 | loss | 1291 | UGT2B15,TMPRSS11E | 46.2 | Exon + ve, ASD > 4, Normals < 2, no Sanger filter applied | 90 |
| 4 | 69069651 | 69643272 | 573621 | gain | 1387 | UGT2B15,TMPRSS11E | 46.2 | Exon + ve, ASD > 4, Normals < 2, no Sanger filter applied | 90 |
| 4 | 69069651 | 69643272 | 573621 | loss | 1555 | UGT2B15,TMPRSS11E | 46.2 | Exon + ve, ASD > 4, Normals < 2, no Sanger filter applied | 90 |
| 4 | 69069651 | 69643272 | 573621 | gain | 1578 | UGT2B15,TMPRSS11E | 46.2 | Exon + ve, ASD > 4, Normals < 2, no Sanger filter applied | 90 |
| 4 | 69069651 | 69643272 | 573621 | gain | 1665 | UGT2B15,TMPRSS11E | 46.2 | Exon + ve, ASD > 4, Normals < 2, no Sanger filter applied | 90 |
| 4 | 69069651 | 69643272 | 573621 | gain | 1667 | UGT2B15,TMPRSS11E | 46.2 | Exon + ve, ASD > 4, Normals < 2, no Sanger filter applied | 90 |
| 4 | 69069651 | 69643272 | 573621 | gain | 1672 | UGT2B15,TMPRSS11E | 46.2 | Exon + ve, ASD > 4, Normals < 2, no Sanger filter applied | 90 |
| 4 | 69069651 | 69665979 | 596328 | loss | 1714 | UGT2B15,TMPRSS11E | 46.2 | Exon + ve, ASD > 4, Normals < 2, no Sanger filter applied | 92 |
| 4 | 69069651 | 69656183 | 586532 | gain | 1715 | UGT2B15,TMPRSS11E | 46.2 | Exon + ve, ASD > 4, Normals < 2, no Sanger filter applied | 99 |
| 4 | 69069651 | 69643272 | 573621 | gain | 1761 | UGT2B15,TMPRSS11E | 46.2 | Exon + ve, ASD > 4, Normals < 2, no Sanger filter applied | 90 |
| 4 | 69069651 | 69643272 | 573621 | gain | 1833 | UGT2B15,TMPRSS11E | 46.2 | Exon + ve, ASD > 4, Normals < 2, no Sanger filter applied | 90 |
| 4 | 69069651 | 69656183 | 586532 | gain | 1842 | UGT2B15,TMPRSS11E | 46.2 | Exon + ve, ASD > 4, Normals < 2, no Sanger filter applied | 99 |
| 4 | 69069651 | 69643272 | 573621 | gain | 1860 | UGT2B15,TMPRSS11E | 46.2 | Exon + ve, ASD > 4, Normals < 2, no Sanger filter applied | 90 |
| 4 | 69069651 | 69643272 | 573621 | gain | 1885 | UGT2B15,TMPRSS11E | 46.2 | Exon + ve, ASD > 4, Normals < 2, no Sanger filter applied | 90 |
| 4 | 69069651 | 69643272 | 573621 | gain | 1894 | UGT2B15,TMPRSS11E | 46.2 | Exon + ve, ASD > 4, Normals < 2, no Sanger filter applied | 90 |
| 4 | 69069651 | 69643272 | 573621 | gain | 1911 | UGT2B15,TMPRSS11E | 46.2 | Exon + ve, ASD > 4, Normals < 2, no Sanger filter applied | 90 |
| 4 | 69069651 | 69643272 | 573621 | gain | 1952 | UGT2B15,TMPRSS11E | 46.2 | Exon + ve, ASD > 4, Normals < 2, no Sanger filter applied | 90 |
| 4 | 69069651 | 69684769 | 615118 | gain | 2001 | UGT2B15,TMPRSS11E | 46.2 | Exon + ve, ASD > 4, Normals < 2, no Sanger filter applied | 100 |
| 4 | 69069651 | 69643272 | 573621 | gain | 2030 | UGT2B15,TMPRSS11E | 46.2 | Exon + ve, ASD > 4, Normals < 2, no Sanger filter applied | 90 |
| 4 | 69069651 | 69696642 | 626991 | gain | 1447 | UGT2B15,TMPRSS11E | 46.2 | Exon + ve, ASD > 4, Normals < 2, no Sanger filter applied | 101 |
| 4 | 69075140 | 69643272 | 568132 | gain | 1691 | UGT2B15,TMPRSS11E | 46.2 | Exon + ve, ASD > 4, Normals < 2, no Sanger filter applied | 94 |
| 4 | 69088563 | 69643272 | 554709 | gain | 1537 | UGT2B15,TMPRSS11E | 46.2 | Exon + ve, ASD > 4, Normals < 2, no Sanger filter applied | 98 |
| 4 | 69120776 | 69687545 | 566769 | gain | 1588 | UGT2B15,TMPRSS11E | 46.2 | Exon + ve, ASD > 4, Normals < 2, no Sanger filter applied | 96 |
| 4 | 71197387 | 71318078 | 120691 | loss | 1242 | CABS1, SMR3A | 2.95 | Exon + ve, 5 > ASD > 1, Normals < 2, Sanger − ve | 681 |
| 4 | 71197387 | 71318078 | 120691 | loss | 1860 | CABS1, SMR3A | 2.95 | Exon + ve, 5 > ASD > 1, Normals < 2, Sanger − ve | 681 |
| 4 | 71197387 | 71318078 | 120691 | loss | 1242 | SMR3B, SMR3A | 4.44 | Exon + ve, 5 > ASD > 1, Normals < 2, Sanger − ve | 681 |
| 4 | 71197387 | 71318078 | 120691 | loss | 1860 | SMR3B, SMR3A | 4.44 | Exon + ve, 5 > ASD > 1, Normals < 2, Sanger − ve | 681 |
| 4 | 71197387 | 71318078 | 120691 | loss | 1242 | PROL1, SMR3B | 2.95 | Exon + ve, 5 > ASD > 1, Normals < 2, Sanger − ve | 681 |
| 4 | 71197387 | 71318078 | 120691 | loss | 1860 | PROL1, SMR3B | 2.95 | Exon + ve, 5 > ASD > 1, Normals < 2, Sanger − ve | 681 |
| 4 | 71263280 | 71284124 | 20844 | loss | 1537 | SMR3B, SMR3A | 4.44 | Exon + ve, ASD > 4, Normals < 2, Sanger − ve | 682 |
| 4 | 94589345 | 94590778 | 1433 | loss | 1391 | GRID2 | 8.91 | Intron + ve, ASD > 4, Normals < 2, no Sanger filter applied | 445 |
| 4 | 94589345 | 94590778 | 1433 | loss | 1418 | GRID2 | 8.91 | Intron + ve, ASD > 4, Normals < 2, no Sanger filter applied | 445 |
| 4 | 94589345 | 94590778 | 1433 | loss | 1724 | GRID2 | 8.91 | Intron + ve, ASD > 4, Normals < 2, no Sanger filter applied | 445 |
| 4 | 94589345 | 94590778 | 1433 | loss | 1777 | GRID2 | 8.91 | Intron + ve, ASD > 4, Normals < 2, no Sanger filter applied | 445 |
| 4 | 94589345 | 94590778 | 1433 | loss | 1821 | GRID2 | 8.91 | Intron + ve, ASD > 4, Normals < 2, no Sanger filter applied | 445 |
| 4 | 94589345 | 94590778 | 1433 | loss | 1864 | GRID2 | 8.91 | Intron + ve, ASD > 4, Normals < 2, no Sanger filter applied | 445 |
| 4 | 119225941 | 119348829 | 22885 | loss | 1753 | NDST3 | 27.22 | Intron + ve, ASD > 4, Normals < 2, no Sanger filter applied | 130 |
| 4 | 119325941 | 119348829 | 22885 | loss | 1753 | NDST3 | 30.33 | Intron + ve, ASD > 4, Normals < 2, no Sanger filter applied | 130 |
| 4 | 119325944 | 119348829 | 22885 | loss | 1234 | NDST3 | 42.98 | Intron + ve, ASD > 4, Normals < 2, no Sanger filter applied | 130 |
| 4 | 119333528 | 119348829 | 15301 | loss | 1307 | NDST3 | 27.22 | Intron + ve, ASD > 4, Normals < 2, no Sanger filter applied | 127 |
| 4 | 119333528 | 119348829 | 15301 | loss | 1392 | NDST3 | 27.22 | Intron + ve, ASD > 4, Normals < 2, no Sanger filter applied | 127 |
| 4 | 119333528 | 119348829 | 15301 | loss | 1413 | NDST3 | 27.22 | Intron + ve, ASD > 4, Normals < 2, no Sanger filter applied | 127 |
| 4 | 119333528 | 119348829 | 15301 | loss | 1428 | NDST3 | 27.22 | Intron + ve, ASD > 4, Normals < 2, no Sanger filter applied | 127 |
| 4 | 119333528 | 119348829 | 15301 | loss | 1560 | NDST3 | 27.22 | Intron + ve, ASD > 4, Normals < 2, no Sanger filter applied | 127 |
| 4 | 119333528 | 119348829 | 15301 | loss | 1798 | NDST3 | 27.22 | Intron + ve, ASD > 4, Normals < 2, no Sanger filter applied | 127 |
| 4 | 119333528 | 119348829 | 15301 | loss | 1800 | NDST3 | 27.22 | Intron + ve, ASD > 4, Normals < 2, no Sanger filter applied | 127 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 4 | 119333528 | 119350354 | 16826 | loss | 1884 | NDST3 | 27.22 | Intron + ve, ASD > 4, Normals < 2, no Sanger filter applied | 131 |
| 4 | 119333528 | 119348829 | 15301 | loss | 1894 | NDST3 | 27.22 | Intron + ve, ASD > 4, Normals < 2, no Sanger filter applied | 127 |
| 4 | 119333528 | 119348829 | 15301 | loss | 1959 | NDST3 | 27.22 | Intron + ve, ASD > 4, Normals < 2, no Sanger filter applied | 127 |
| 4 | 119333528 | 119348829 | 15301 | loss | 1962 | NDST3 | 27.22 | Intron + ve, ASD > 4, Normals < 2, no Sanger filter applied | 127 |
| 4 | 119333528 | 119348829 | 15301 | loss | 1966 | NDST3 | 27.22 | Intron + ve, ASD > 4, Normals < 2, no Sanger filter applied | 127 |
| 4 | 119333528 | 119348829 | 15301 | loss | 1969 | NDST3 | 27.22 | Intron + ve, ASD > 4, Normals < 2, no Sanger filter applied | 127 |
| 4 | 119333528 | 119348829 | 15301 | loss | 2023 | NDST3 | 27.22 | Intron + ve, ASD > 4, Normals < 2, no Sanger filter applied | 127 |
| 4 | 119333528 | 119348829 | 15301 | loss | 2034 | NDST3 | 27.22 | Intron + ve, ASD > 4, Normals < 2, no Sanger filter applied | 127 |
| 4 | 119333528 | 119348829 | 15301 | loss | 2042 | NDST3 | 27.22 | Intron + ve, ASD > 4, Normals < 2, no Sanger filter applied | 127 |
| 4 | 119333528 | 119348829 | 15301 | loss | 1234 | NDST3 | 30.33 | Intron + ve, ASD > 4, Normals < 2, no Sanger filter applied | 127 |
| 4 | 119333528 | 119348829 | 15301 | loss | 1307 | NDST3 | 30.33 | Intron + ve, ASD > 4, Normals < 2, no Sanger filter applied | 127 |
| 4 | 119333528 | 119348829 | 15301 | loss | 1392 | NDST3 | 30.33 | Intron + ve, ASD > 4, Normals < 2, no Sanger filter applied | 127 |
| 4 | 119333528 | 119348829 | 15301 | loss | 1413 | NDST3 | 30.33 | Intron + ve, ASD > 4, Normals < 2, no Sanger filter applied | 127 |
| 4 | 119333528 | 119348829 | 15301 | loss | 1428 | NDST3 | 30.33 | Intron + ve, ASD > 4, Normals < 2, no Sanger filter applied | 127 |
| 4 | 119333528 | 119348829 | 15301 | loss | 1560 | NDST3 | 30.33 | Intron + ve, ASD > 4, Normals < 2, no Sanger filter applied | 127 |
| 4 | 119333528 | 119348829 | 15301 | loss | 1798 | NDST3 | 30.33 | Intron + ve, ASD > 4, Normals < 2, no Sanger filter applied | 127 |
| 4 | 119333528 | 119348829 | 15301 | loss | 1800 | NDST3 | 30.33 | Intron + ve, ASD > 4, Normals < 2, no Sanger filter applied | 127 |
| 4 | 119333528 | 119350354 | 16826 | loss | 1884 | NDST3 | 30.33 | Intron + ve, ASD > 4, Normals < 2, no Sanger filter applied | 131 |
| 4 | 119333528 | 119348829 | 15301 | loss | 1894 | NDST3 | 30.33 | Intron + ve, ASD > 4, Normals < 2, no Sanger filter applied | 127 |
| 4 | 119333528 | 119348829 | 15301 | loss | 1959 | NDST3 | 30.33 | Intron + ve, ASD > 4, Normals < 2, no Sanger filter applied | 127 |
| 4 | 119333528 | 119348829 | 15301 | loss | 1962 | NDST3 | 30.33 | Intron + ve, ASD > 4, Normals < 2, no Sanger filter applied | 127 |
| 4 | 119333528 | 119348829 | 15301 | loss | 1966 | NDST3 | 30.33 | Intron + ve, ASD > 4, Normals < 2, no Sanger filter applied | 127 |
| 4 | 119333528 | 119348829 | 15301 | loss | 1969 | NDST3 | 30.33 | Intron + ve, ASD > 4, Normals < 2, no Sanger filter applied | 127 |
| 4 | 119333528 | 119348829 | 15301 | loss | 2023 | NDST3 | 30.33 | Intron + ve, ASD > 4, Normals < 2, no Sanger filter applied | 127 |
| 4 | 119333528 | 119348829 | 15301 | loss | 2034 | NDST3 | 30.33 | Intron + ve, ASD > 4, Normals < 2, no Sanger filter applied | 127 |
| 4 | 119333528 | 119348829 | 15301 | loss | 2042 | NDST3 | 30.33 | Intron + ve, ASD > 4, Normals < 2, no Sanger filter applied | 127 |
| 4 | 119333528 | 119348829 | 15301 | loss | 1234 | NDST3 | 42.98 | Intron + ve, ASD > 4, Normals < 2, no Sanger filter applied | 127 |
| 4 | 119333528 | 119348829 | 15301 | loss | 1307 | NDST3 | 42.98 | Intron + ve, ASD > 4, Normals < 2, no Sanger filter applied | 127 |
| 4 | 119333528 | 119348829 | 15301 | loss | 1392 | NDST3 | 42.98 | Intron + ve, ASD > 4, Normals < 2, no Sanger filter applied | 127 |
| 4 | 119333528 | 119348829 | 15301 | loss | 1413 | NDST3 | 42.98 | Intron + ve, ASD > 4, Normals < 2, no Sanger filter applied | 127 |
| 4 | 119333528 | 119348829 | 15301 | loss | 1428 | NDST3 | 42.98 | Intron + ve, ASD > 4, Normals < 2, no Sanger filter applied | 127 |
| 4 | 119333528 | 119348829 | 15301 | loss | 1560 | NDST3 | 42.98 | Intron + ve, ASD > 4, Normals < 2, no Sanger filter applied | 127 |
| 4 | 119333528 | 119348829 | 15301 | loss | 1798 | NDST3 | 42.98 | Intron + ve, ASD > 4, Normals < 2, no Sanger filter applied | 127 |
| 4 | 119333528 | 119348829 | 15301 | loss | 1800 | NDST3 | 42.98 | Intron + ve, ASD > 4, Normals < 2, no Sanger filter applied | 127 |
| 4 | 119333528 | 119350354 | 16826 | loss | 1884 | NDST3 | 42.98 | Intron + ve, ASD > 4, Normals < 2, no Sanger filter applied | 131 |
| 4 | 119333528 | 119348829 | 15301 | loss | 1894 | NDST3 | 42.98 | Intron + ve, ASD > 4, Normals < 2, no Sanger filter applied | 127 |
| 4 | 119333528 | 119348829 | 15301 | loss | 1959 | NDST3 | 42.98 | Intron + ve, ASD > 4, Normals < 2, no Sanger filter applied | 127 |
| 4 | 119333528 | 119348829 | 15301 | loss | 1962 | NDST3 | 42.98 | Intron + ve, ASD > 4, Normals < 2, no Sanger filter applied | 127 |
| 4 | 119333528 | 119348829 | 15301 | loss | 1966 | NDST3 | 42.98 | Intron + ve, ASD > 4, Normals < 2, no Sanger filter applied | 127 |
| 4 | 119333528 | 119348829 | 15301 | loss | 1969 | NDST3 | 42.98 | Intron + ve, ASD > 4, Normals < 2, no Sanger filter applied | 127 |
| 4 | 119333528 | 119348829 | 15301 | loss | 2023 | NDST3 | 42.98 | Intron + ve, ASD > 4, Normals < 2, no Sanger filter applied | 127 |
| 4 | 119333528 | 119348829 | 15301 | loss | 2034 | NDST3 | 42.98 | Intron + ve, ASD > 4, Normals < 2, no Sanger filter applied | 127 |
| 4 | 119333528 | 119348829 | 15301 | loss | 2042 | NDST3 | 42.98 | Intron + ve, ASD > 4, Normals < 2, no Sanger filter applied | 127 |
| 4 | 119333701 | 119348829 | 15128 | loss | 1718 | NDST3 | 30.33 | Intron + ve, ASD > 4, Normals < 2, no Sanger filter applied | 131 |
| 4 | 119333701 | 119348829 | 15128 | loss | 1550 | NDST3 | 30.33 | Intron + ve, ASD > 4, Normals < 2, no Sanger filter applied | 129 |
| 4 | 119333701 | 119348829 | 15128 | loss | 1718 | NDST3 | 42.98 | Intron + ve, ASD > 4, Normals < 2, no Sanger filter applied | 129 |
| 4 | 119333701 | 119348829 | 15128 | loss | 1550 | NDST3 | 42.98 | Intron + ve, ASD > 4, Normals < 2, no Sanger filter applied | 129 |
| 4 | 119334954 | 119348829 | 13875 | loss | 1290 | NDST3 | 42.98 | Intron + ve, ASD > 4, Normals < 2, no Sanger filter applied | 128 |
| 4 | 119334954 | 119348829 | 13875 | loss | 1629 | NDST3 | 42.98 | Intron + ve, ASD > 4, Normals < 2, no Sanger filter applied | 128 |
| 4 | 119334954 | 119348829 | 13875 | loss | 1659 | NDST3 | 12.0s | Intron + ve, ASD > 4, Normals < 2, no Sanger filter applied | 128 |
| 4 | 119334954 | 119348829 | 13875 | loss | 1708 | NDST3 | 42.98 | Intron + ve, ASD > 4, Normals < 2, no Sanger filter applied | 128 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 4 | 119334954 | 119348829 | 13875 | loss | 1720 | NDST3 | 42.98 | Intron + ve, ASD > 4, Normals < 2, no Sanger filter applied | 128 |
| 4 | 119334954 | 119348829 | 13875 | loss | 1824 | NDST3 | 42.98 | Intron + ve, ASD > 4, Normals < 2, no Sanger filter applied | 128 |
| 4 | 119334954 | 119348829 | 13875 | loss | 1946 | NDST3 | 42.98 | Intron + ve, ASD > 4, Normals < 2, no Sanger filter applied | 128 |
| 4 | 119334954 | 119348829 | 13875 | loss | 2020 | NDST3 | 42.98 | Intron + ve, ASD > 4, Normals < 2, no Sanger filter applied | 128 |
| 4 | 129950848 | 129952427 | 1579 | gain | 1261 | PHF17 | 27.22 | Intron + ve, ASD > 4, Normals < 2, no Sanger filter applied | 222 |
| 4 | 129950848 | 129952427 | 1579 | gain | 1272 | PHF17 | 27.22 | Intron + ve, ASD > 4, Normals < 2, no Sanger filter applied | 222 |
| 4 | 129950848 | 129952427 | 1579 | loss | 1542 | PHF17 | 27.22 | Intron + ve, ASD > 4, Normals < 2, no Sanger filter applied | 222 |
| 4 | 129950848 | 129952427 | 1579 | gain | 1572 | PHF17 | 27.22 | Intron + ve, ASD > 4, Normals < 2, no Sanger filter applied | 222 |
| 4 | 129950848 | 129952427 | 1579 | gain | 1585 | PHF17 | 27.22 | Intron + ve, ASD > 4, Normals < 2, no Sanger filter applied | 222 |
| 4 | 129950848 | 129952427 | 1579 | gain | 1696 | PHF17 | 27.22 | Intron + ve, ASD > 4, Normals < 2, no Sanger filter applied | 222 |
| 4 | 129950848 | 129952427 | 1579 | loss | 1703 | PHF17 | 27.22 | Intron + ve, ASD > 4, Normals < 2, no Sanger filter applied | 222 |
| 4 | 129950848 | 129952427 | 1579 | gain | 1710 | PHF17 | 27.22 | Intron + ve, ASD > 4, Normals < 2, no Sanger filter applied | 222 |
| 4 | 129950848 | 129952427 | 1579 | loss | 1721 | PHF17 | 27.22 | Intron + ve, ASD > 4, Normals < 2, no Sanger filter applied | 222 |
| 4 | 129950848 | 129952427 | 1579 | gain | 1724 | PHF17 | 27.22 | Intron + ve, ASD > 4, Normals < 2, no Sanger filter applied | 222 |
| 4 | 129950848 | 129952427 | 1579 | gain | 1743 | PHF17 | 27.22 | Intron + ve, ASD > 4, Normals < 2, no Sanger filter applied | 222 |
| 4 | 129950848 | 129952427 | 1579 | gain | 1776 | PHF17 | 27.22 | Intron + ve, ASD > 4, Normals < 2, no Sanger filter applied | 222 |
| 4 | 129950848 | 129952427 | 1579 | gain | 1818 | PHF17 | 27.22 | Intron + ve, ASD > 4, Normals < 2, no Sanger filter applied | 222 |
| 4 | 129950848 | 129952427 | 1579 | gain | 1860 | PHF17 | 27.22 | Intron + ve, ASD > 4, Normals < 2, no Sanger filter applied | 222 |
| 4 | 129950848 | 129952427 | 1579 | loss | 1883 | PHF17 | 27.22 | Intron + ve, ASD > 4, Normals < 2, no Sanger filter applied | 222 |
| 4 | 129950848 | 129952427 | 1579 | gain | 1908 | PHF17 | 27.22 | Intron + ve, ASD > 4, Normals < 2, no Sanger filter applied | 222 |
| 4 | 129950848 | 129952427 | 1579 | loss | 2031 | PHF17 | 27.22 | Intron + ve, ASD > 4, Normals < 2, no Sanger filter applied | 222 |
| 4 | 129950848 | 129952427 | 1579 | loss | 2044 | PHF17 | 27.22 | Intron + ve, ASD > 4, Normals < 2, no Sanger filter applied | 222 |
| 4 | 145201241 | 145265078 | 63837 | gain | 1426 | GYPA | 4.44 | Exon + ve, 5 > ASD > 1, Normals < 2, Sanger − ve | 683 |
| 4 | 145240937 | 145255693 | 14756 | gain | 1929 | GYPA | 4.44 | Exon + ve, 5 > ASD > 1, Normals < 2, Sanger − ve | 685 |
| 4 | 145242544 | 145255693 | 13149 | gain | 1677 | GYPA | 4.44 | Exon + ve, 5 > ASD > 1, Normals < 2, Sanger − ve | 684 |
| 4 | 173659100 | 173672958 | 13858 | gain | 1230 | GALNTL6 | 8.91 | Intron + ve, ASD > 4, Normals < 2, no Sanger filter applied | 446 |
| 4 | 173659100 | 173674198 | 15098 | gain | 1250 | GALNTL6 | 8.91 | Intron + ve, ASD > 4, Normals < 2, no Sanger filter applied | 447 |
| 4 | 173659100 | 173672958 | 13858 | gain | 1396 | GALNTL6 | 8.91 | Intron + ve, ASD > 4, Normals < 2, no Sanger filter applied | 446 |
| 4 | 173659100 | 173672958 | 13858 | gain | 1798 | GALNTL6 | 8.91 | Intron + ve, ASD > 4, Normals < 2, no Sanger filter applied | 446 |
| 4 | 173659100 | 173666072 | 6972 | gain | 1834 | GALNTL6 | 8.91 | Intron + ve, ASD > 4, Normals < 2, no Sanger filter applied | 448 |
| 4 | 173659100 | 173666072 | 6972 | gain | 2034 | GALNTL6 | 8.91 | Intron + ve, ASD > 4, Normals < 2, no Sanger filter applied | 448 |
| 4 | 173659100 | 173672958 | 13858 | gain | 2034 | GALNTL6 | 8.91 | Intron + ve, ASD > 4, Normals < 2, no Sanger filter applied | 446 |
| 4 | 173659100 | 173674198 | 15098 | gain | 1250 | GALNTL6 | 8.91 | Intron + ve, ASD > 4, Normals < 2, no Sanger filter applied | 447 |
| 4 | 173659100 | 173672958 | 13858 | gain | 1396 | GALNTL6 | 8.91 | Intron + ve, ASD > 4, Normals < 2, no Sanger filter applied | 446 |
| 4 | 173659100 | 173672958 | 13858 | gain | 1798 | GALNTL6 | 8.91 | Intron + ve, ASD > 4, Normals < 2, no Sanger filter applied | 446 |
| 4 | 173659100 | 173666072 | 6972 | gain | 1834 | GALNTL6 | 8.91 | Intron + ve, ASD > 4, Normals < 2, no Sanger filter applied | 448 |
| 4 | 173659100 | 173666072 | 6972 | gain | 2034 | GALNTL6 | 8.91 | Intron + ve, ASD > 4, Normals < 2, no Sanger filter applied | 448 |
| 4 | 175860235 | 175863396 | 3161 | gain | 1288 | GLRA3 | 13.43 | Intron + ve, ASD > 4, Normals < 2, no Sanger filter applied | 328 |
| 4 | 175860235 | 175863396 | 3161 | gain | 1534 | GLRA3 | 13.43 | Intron + ve, ASD > 4, Normals < 2, no Sanger filter applied | 328 |
| 4 | 175860235 | 175863396 | 3161 | gain | 1570 | GLRA3 | 13.43 | Intron + ve, ASD > 4, Normals < 2, no Sanger filter applied | 328 |
| 4 | 175860235 | 175863396 | 3161 | gain | 1571 | GLRA3 | 13.43 | Intron + ve, ASD > 4, Normals < 2, no Sanger filter applied | 328 |
| 4 | 175860235 | 175863396 | 3161 | gain | 1821 | GLRA3 | 13.43 | Intron + ve, ASD > 4, Normals < 2, no Sanger filter applied | 328 |
| 4 | 175860235 | 175863396 | 3161 | gain | 1860 | GLRA3 | 13.43 | Intron + ve, ASD > 4, Normals < 2, no Sanger filter applied | 328 |
| 4 | 175860235 | 175863396 | 3161 | gain | 1911 | GLRA3 | 13.43 | Intron + ve, ASD > 4, Normals < 2, no Sanger filter applied | 328 |
| 4 | 175860235 | 175863396 | 3161 | gain | 1931 | GLRA3 | 13.43 | Intron + ve, ASD > 4, Normals < 2, no Sanger filter applied | 328 |
| 4 | 175860235 | 175863396 | 3161 | gain | 2032 | GLRA3 | 13.43 | Intron + ve, ASD > 4, Normals < 2, no Sanger filter applied | 328 |
| 4 | 188089090 | 190030740 | 1941650 | gain | 1691 | TRIML2 | 4.44 | Exon + ve, 5 > ASD > 1, Normals < 2, Sanger − ve | 687 |
| 4 | 188089090 | 190030740 | 1941650 | gain | 1691 | LOC401164 | 2.95 | Exon + ve, 5 > ASD > 1, Normals < 2, Sanger − ve | 687 |
| 4 | 188688388 | 189297555 | 609167 | gain | 1704 | TRIML2 | 4.44 | Exon + ve, 5 > ASD > 1, Normals < 2, Sanger − ve | 688 |
| 4 | 188688388 | 189297555 | 609167 | gain | 1704 | TRIML2 | 2.95 | Exon + ve, 5 > ASD > 1, Normals < 2, Sanger − ve | 688 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 4 | 189229198 | 189255442 | 26244 | loss | 1619 | TRIML2 | 4.44 | Exon + ve, 5 > ASD > 1, Normals < 2, Sanger – ve | 686 |
| 4 | 189421034 | 189866429 | 445395 | loss | 1499 | LOC401164 | 4.44 | Exon + ve, 5 > ASD > 1, Normals < 2, Sanger – ve | 689 |
| 4 | 189499856 | 189863764 | 363908 | gain | 1534 | LOC401164 | 4.44 | Exon + ve, 5 > ASD > 1, Normals < 2, Sanger – ve | 690 |
| 4 | 191041481 | 191153613 | 112132 | gain | 1230 | TUBB4Q | 4.44 | Exon + ve, 5 > ASD > 1, Normals < 2, Sanger – ve | 691 |
| 4 | 191041481 | 191153613 | 112132 | gain | 1292 | TUBB4Q | 4.44 | Exon + ve, 5 > ASD > 1, Normals < 2, Sanger – ve | 691 |
| 4 | 191133836 | 191153613 | 19777 | loss | 1696 | TUBB4Q | 4.44 | Exon + ve, 5 > ASD > 1, Normals < 2, Sanger – ve | 692 |
| 5 | 9279249 | 12716482 | 3437233 | loss | 1850 | ANKRD33B | 19.51 | Intron + ve, ASD > 4, Normals < 2, no Sanger filter applied | 13 |
| 5 | 9279249 | 12716482 | 3437233 | loss | 1850 | CTNND2 | 2.95 | Intron + ve, ASD > 4, Normals < 2, no Sanger filter applied | 13 |
| 5 | 10677114 | 10699881 | 22767 | loss | 1666 | ANKRD33B | 19.51 | Intron + ve, ASD > 4, Normals < 2, no Sanger filter applied | 11 |
| 5 | 10683077 | 10691335 | 8258 | loss | 1438 | ANKRD33B | 19.51 | Intron + ve, ASD > 4, Normals < 2, no Sanger filter applied | 10 |
| 5 | 10683077 | 10691335 | 8258 | loss | 1619 | ANKRD33B | 19.51 | Intron + ve, ASD > 4, Normals < 2, no Sanger filter applied | 10 |
| 5 | 10683077 | 10691335 | 8258 | loss | 1629 | ANKRD33B | 19.51 | Intron + ve, ASD > 4, Normals < 2, no Sanger filter applied | 10 |
| 5 | 10683077 | 10691335 | 8258 | loss | 1630 | ANKRD33B | 19.51 | Intron + ve, ASD > 4, Normals < 2, no Sanger filter applied | 10 |
| 5 | 10683077 | 10688336 | 5259 | loss | 1696 | ANKRD33B | 19.51 | Intron + ve, ASD > 4, Normals < 2, no Sanger filter applied | 12 |
| 5 | 10683077 | 10688336 | 5259 | loss | 1916 | ANKRD33B | 19.51 | Intron + ve, ASD > 4, Normals < 2, no Sanger filter applied | 12 |
| 5 | 10683077 | 10688336 | 5259 | loss | 1958 | ANKRD33B | 19.51 | Intron + ve, ASD > 4, Normals < 2, no Sanger filter applied | 12 |
| 5 | 10683077 | 10688336 | 5259 | loss | 1965 | ANKRD33B | 19.51 | Intron + ve, ASD > 4, Normals < 2, no Sanger filter applied | 12 |
| 5 | 10683077 | 10691335 | 8258 | loss | 1998 | ANKRD33B | 19.51 | Intron + ve, ASD > 4, Normals < 2, no Sanger filter applied | 10 |
| 5 | 10683077 | 10691335 | 8258 | loss | 2026 | ANKRD33B | 19.51 | Intron + ve, ASD > 4, Normals < 2, no Sanger filter applied | 10 |
| 5 | 10683077 | 10688336 | 5259 | loss | 2012 | ANKRD33B | 19.51 | Intron + ve, ASD > 4, Normals < 2, no Sanger filter applied | 12 |
| 5 | 11924716 | 12010455 | 85739 | gain | 1946 | CTNND2 | 2.95 | Exon + ve, 5 > ASD > 1, Normals < 2, Sanger – ve | 760 |
| 5 | 136992201 | 136995509 | 3308 | loss | 1671 | KLHL3 | 8.91 | Intron + ve, ASD > 4, Normals < 2, no Sanger filter applied | 450 |
| 5 | 136994174 | 136995509 | 1335 | loss | 1522 | KLHL3 | 8.91 | Intron + ve, ASD > 4, Normals < 2, no Sanger filter applied | 449 |
| 5 | 136994174 | 136995509 | 1335 | loss | 1730 | KLHL3 | 8.91 | Intron + ve, ASD > 4, Normals < 2, no Sanger filter applied | 449 |
| 5 | 136994174 | 136995509 | 1335 | loss | 1742 | KLHL3 | 8.91 | Intron + ve, ASD > 4, Normals < 2, no Sanger filter applied | 449 |
| 5 | 136994174 | 136995509 | 1335 | loss | 1856 | KLHL3 | 8.91 | Intron + ve, ASD > 4, Normals < 2, no Sanger filter applied | 449 |
| 5 | 136991171 | 136995509 | 1335 | loss | 1917 | KLHL3 | 8.91 | Intron + ve, ASD > 4, Normals < 2, no Sanger filter applied | 449 |
| 5 | 138301606 | 138313486 | 11880 | loss | 1309 | SIL1 | 4.44 | Exon + ve, 5 > ASD > 1, Normals < 2, Sanger – ve | 693 |
| 5 | 138301606 | 138313486 | 11880 | gain | 1395 | SIL1 | 4.44 | Exon + ve, 5 > ASD > 1, Normals < 2, Sanger – ve | 693 |
| 5 | 138301606 | 138313486 | 11880 | gain | 1411 | SIL1 | 4.44 | Exon + ve, 5 > ASD > 1, Normals < 2, Sanger – ve | 693 |
| 5 | 140535820 | 140541178 | 5358 | loss | 1425 | PCDHB8, PCDHB16 | 16.46 | Exon + ve, ASD > 4, Normals < 2, no Sanger filter applied | 282 |
| 5 | 140535820 | 140541178 | 5358 | loss | 1439 | PCDHB8, PCDHB16 | 16.46 | Exon + ve, ASD > 4, Normals < 2, no Sanger filter applied | 282 |
| 5 | 140535820 | 140541178 | 5358 | loss | 1441 | PCDHB8, PCDHB16 | 16.46 | Exon + ve, ASD > 4, Normals < 2, no Sanger filter applied | 282 |
| 5 | 140535820 | 140541178 | 5358 | loss | 1490 | PCDHB8, PCDHB16 | 16.46 | Exon + ve, ASD > 4, Normals < 2, no Sanger filter applied | 282 |
| 5 | 140535820 | 140541178 | 5358 | loss | 1493 | PCDHB8, PCDHB16 | 16.46 | Exon + ve, ASD > 4, Normals < 2, no Sanger filter applied | 282 |
| 5 | 140535820 | 140541178 | 5358 | loss | 1515 | PCDHB8, PCDHB16 | 16.46 | Exon + ve, ASD > 4, Normals < 2, no Sanger filter applied | 282 |
| 5 | 140535820 | 140541178 | 5358 | loss | 1555 | PCDHB8, PCDHB16 | 16.46 | Exon + ve, ASD > 4, Normals < 2, no Sanger filter applied | 282 |
| 5 | 140535820 | 140541178 | 5358 | loss | 1564 | PCDHB8, PCDHB16 | 16.46 | Exon + ve, ASD > 4, Normals < 2, no Sanger filter applied | 282 |
| 5 | 140535820 | 140541178 | 5358 | loss | 1580 | PCDHB8, PCDHB16 | 16.46 | Exon + ve, ASD > 4, Normals < 2, no Sanger filter applied | 282 |
| 5 | 140535820 | 140541178 | 5358 | loss | 1582 | PCDHB8, PCDHB16 | 16.46 | Exon + ve, ASD > 4, Normals < 2, no Sanger filter applied | 282 |
| 5 | 140535820 | 140541178 | 5358 | loss | 1611 | PCDHB8, PCDHB16 | 16.46 | Exon + ve, ASD > 4, Normals < 2, no Sanger filter applied | 282 |
| 5 | 147861447 | 147867311 | 5864 | loss | 1307 | HTR4 | 8.91 | Intron + ve, ASD > 4, Normals < 2, no Sanger filter applied | 451 |
| 5 | 147861447 | 147867311 | 5864 | loss | 1393 | HTR4 | 8.91 | Intron + ve, ASD > 4, Normals < 2, no Sanger filter applied | 451 |
| 5 | 147861447 | 147867311 | 5864 | loss | 1729 | HTR4 | 8.91 | Intron + ve, ASD > 4, Normals < 2, no Sanger filter applied | 451 |
| 5 | 147861447 | 147867311 | 5864 | loss | 1740 | HTR4 | 8.91 | Intron + ve, ASD > 4, Normals < 2, no Sanger filter applied | 451 |
| 5 | 147861447 | 147867311 | 5864 | loss | 1742 | HTR4 | 8.91 | Intron + ve, ASD > 4, Normals < 2, no Sanger filter applied | 451 |
| 5 | 147861447 | 47841 | 5864 | loss | 1405 | HTR4 | 8.91 | Intron + ve, ASD > 4, Normals < 2, no Sanger filter applied | 151 |
| 5 | 150159466 | 150207307 | 47841 | loss | 1831 | IRGM | 4.44 | Exon + ve, 5 > ASD > 1, Normals < 2, Sanger – ve | 694 |
| 5 | 150185190 | 150207307 | 22117 | loss | 1696 | IRGM | 4.44 | Exon + ve, 5 > ASD > 1, Normals < 2, Sanger – ve | 696 |
| 5 | 150191322 | 150207307 | 15985 | loss | 1696 | IRGM | 4.44 | Exon + ve, 5 > ASD > 1, Normals < 2, Sanger – ve | 695 |
| 5 | 180189516 | 180362342 | 172826 | loss | 1229 | BTNF8, LOC729678, ZFP62 | 49.43 | Exon + ve, ASD > 4, Normals < 2, no Sanger filter applied | 80 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 5 | 180189516 | 180365977 | 176461 | loss | 1532 | BTNL8, LOC729678, ZFP62 | 49.43 | Exon + ve, ASD > 4, Normals < 2, no Sanger filter applied | 84 |
| 5 | 180189516 | 180362342 | 172826 | loss | 1548 | BTNL8, LOC729678, ZFP62 | 49.43 | Exon + ve, ASD > 4, Normals < 2, no Sanger filter applied | 80 |
| 5 | 180189516 | 180365977 | 176461 | loss | 1612 | BTNL8, LOC729678, ZFP62 | 49.43 | Exon + ve, ASD > 4, Normals < 2, no Sanger filter applied | 84 |
| 5 | 180189516 | 180357210 | 167694 | loss | 1686 | BTNL8, LOC729678, ZFP62 | 49.43 | Exon + ve, ASD > 4, Normals < 2, no Sanger filter applied | 84 |
| 5 | 180189516 | 180357210 | 167694 | loss | 1861 | BTNL8, LOC729678, ZFP62 | 49.43 | Exon + ve, ASD > 4, Normals < 2, no Sanger filter applied | 87 |
| 5 | 180192214 | 180362342 | 170128 | gain | 1316 | BTNL8, LOC729678, ZFP62 | 49.43 | Exon + ve, ASD > 4, Normals < 2, no Sanger filter applied | 82 |
| 5 | 180192214 | 180362342 | 170128 | loss | 1580 | BTNL8, LOC729678, ZFP62 | 49.43 | Exon + ve, ASD > 4, Normals < 2, no Sanger filter applied | 82 |
| 5 | 180192214 | 180365977 | 173763 | loss | 1606 | BTNL8, LOC729678, ZFP62 | 49.43 | Exon + ve, ASD > 4, Normals < 2, no Sanger filter applied | 86 |
| 5 | 180192214 | 180362342 | 170128 | loss | 1641 | BTNL8, LOC729678, ZFP62 | 49.43 | Exon + ve, ASD > 4, Normals < 2, no Sanger filter applied | 82 |
| 5 | 180194323 | 180362342 | 168019 | gain | 1253 | BTNL8, LOC729678, ZFP62 | 49.43 | Exon + ve, ASD > 4, Normals < 2, no Sanger filter applied | 81 |
| 5 | 180194323 | 180362342 | 168019 | gain | 1426 | BTNL8, LOC729678, ZFP62 | 49.43 | Exon + ve, ASD > 4, Normals < 2, no Sanger filter applied | 81 |
| 5 | 180194323 | 180378586 | 184263 | loss | 1429 | BTNL8, LOC729678, ZFP62 | 49.43 | Exon + ve, ASD > 4, Normals < 2, no Sanger filter applied | 83 |
| 5 | 180194323 | 180362342 | 168019 | gain | 1441 | BTNL8, LOC729678, ZFP62 | 49.43 | Exon + ve, ASD > 4, Normals < 2, no Sanger filter applied | 81 |
| 5 | 180194323 | 180362342 | 168019 | gain | 1442 | BTNL8, LOC729678, ZFP62 | 49.43 | Exon + ve, ASD > 4, Normals < 2, no Sanger filter applied | 81 |
| 5 | 180194323 | 180362342 | 168019 | gain | 1495 | BTNL8, LOC729678, ZFP62 | 49.43 | Exon + ve, ASD > 4, Normals < 2, no Sanger filter applied | 81 |
| 5 | 180194323 | 180362342 | 168019 | gain | 1496 | BTNL8, LOC729678, ZFP62 | 49.43 | Exon + ve, ASD > 4, Normals < 2, no Sanger filter applied | 81 |
| 5 | 180194323 | 180362342 | 168019 | gain | 1502 | BTNL8, LOC729678, ZFP62 | 49.43 | Exon + ve, ASD > 4, Normals < 2, no Sanger filter applied | 81 |
| 5 | 180194323 | 180362342 | 168019 | gain | 1504 | BTNL8, LOC729678, ZFP62 | 49.43 | Exon + ve, ASD > 4, Normals < 2, no Sanger filter applied | 81 |
| 5 | 180194323 | 180362342 | 168019 | gain | 1517 | BTNL8, LOC729678, ZFP62 | 49.43 | Exon + ve, ASD > 4, Normals < 2, no Sanger filter applied | 81 |
| 5 | 180194323 | 180365977 | 171654 | loss | 1546 | BTNL8, LOC729678, ZFP62 | 49.43 | Exon + ve, ASD > 4, Normals < 2, no Sanger filter applied | 85 |
| 5 | 180194323 | 180378586 | 184263 | loss | 1634 | BTNL8, LOC729678, ZFP62 | 49.43 | Exon + ve, ASD > 4, Normals < 2, no Sanger filter applied | 83 |
| 5 | 180194323 | 180362342 | 168019 | gain | 1648 | BTNL8, LOC729678, ZFP62 | 49.43 | Exon + ve, ASD > 4, Normals < 2, no Sanger filter applied | 81 |
| 5 | 180194323 | 180365977 | 171654 | loss | 1696 | BTNL8, LOC729678, ZFP62 | 49.43 | Exon + ve, ASD > 4, Normals < 2, no Sanger filter applied | 85 |
| 5 | 180194323 | 180365977 | 171654 | loss | 1792 | BTNL8, LOC729678, ZFP62 | 49.43 | Exon + ve, ASD > 4, Normals < 2, no Sanger filter applied | 85 |
| 5 | 180194323 | 180362342 | 168019 | loss | 1805 | BTNL8, LOC729678, ZFP62 | 49.43 | Exon + ve, ASD > 4, Normals < 2, no Sanger filter applied | 81 |
| 5 | 180194323 | 180378586 | 184263 | loss | 1851 | BTOL8, LOC729678, ZFP62 | 49.43 | Exon + ve, ASD > 4, Normals < 2, no Sanger filter applied | 83 |
| 5 | 180194323 | 180362342 | 168019 | loss | 1897 | BTNL8, LOC729678, ZFP62 | 49.43 | Exon + ve, ASD > 4, Normals < 2, no Sanger filter applied | 81 |
| 5 | 180194323 | 180378586 | 184263 | loss | 1902 | BTNL8, LOC729678, ZFP62 | 49.43 | Exon + ve, ASD > 4, Normals < 2, no Sanger filter applied | 83 |
| 5 | 180194323 | 180365977 | 171654 | loss | 1927 | BTNF8, LOC729678, ZFP62 | 49.43 | Exon + ve, ASD > 4, Normals < 2, no Sanger filter applied | 85 |
| 5 | 180194323 | 180362342 | 168019 | gain | 1997 | BTNL8, LOC729678, ZFP62 | 49.43 | Exon + ve, ASD > 4, Normals < 2, no Sanger filter applied | 81 |
| 5 | 180194323 | 180362342 | 168019 | loss | 2035 | BTNL8, LOC729678, ZFP62 | 49.43 | Exon + ve, ASD > 4, Normals < 2, no Sanger filter applied | 81 |
| 6 | 26795887 | 26868101 | 72517 | gain | 1538 | | 36.62 | high OK intergenic (OR > 30) | 179 |
| 6 | 26801068 | 26861184 | 60116 | loss | 1224 | | 36.62 | high OR intergenic (OR > 30) | 174 |
| 6 | 26801068 | 26868404 | 67336 | loss | 1252 | | 36.62 | high OR intergenic (OR > 30) | 175 |
| 6 | 26801068 | 26861184 | 60116 | loss | 1572 | | 36.62 | high OR intergenic (OR > 30) | 174 |
| 6 | 26811016 | 26861184 | 50168 | loss | 1273 | | 36.62 | high OR intergenic (OR > 30) | 176 |
| 6 | 26811016 | 26861184 | 50168 | loss | 1286 | | 36.62 | high OR intergenic (OR > 30) | 176 |
| 6 | 26811016 | 26861184 | 50168 | loss | 1293 | | 36.62 | high OR inlergenic (OR > 30) | 176 |
| 6 | 26811016 | 26861184 | 50168 | loss | 1307 | | 36.62 | high OR intergenic (OR > 30) | 176 |
| 6 | 26811016 | 26861184 | 50168 | loss | 1411 | | 36.62 | high OR intergenic (OR > 30) | 176 |
| 6 | 26811016 | 26861184 | 50168 | loss | 1419 | | 36.62 | high OR intergenic (OR > 30) | 176 |
| 6 | 26811016 | 26861184 | 50168 | loss | 1475 | | 36.62 | high OR intergenic (OR > 30) | 176 |
| 6 | 26811016 | 26863540 | 52524 | gain | 1485 | | 36.62 | high OR intergenic (OR > 30) | 177 |
| 6 | 26811016 | 26868404 | 57388 | gain | 1525 | | 36.62 | high OR intergenic (OR > 30) | 178 |
| 6 | 26811016 | 26861184 | 50168 | gain | 1599 | | 36.62 | high OR intergenic (OR > 30) | 176 |
| 6 | 26811016 | 26863540 | 52524 | loss | 1602 | | 36.62 | high OR intergenic (OR > 30) | 177 |
| 6 | 26811016 | 26861184 | 50168 | loss | 1615 | | 36.62 | high OR intergenic (OR > 30) | 176 |
| 6 | 26811016 | 26863540 | 52524 | gain | 1628 | | 36.62 | high OR intergenic (OR > 30) | 177 |
| 6 | 26811016 | 26861184 | 50168 | loss | 1629 | | 36.62 | high OR intergenic (OR > 30) | 176 |
| 6 | 26811016 | 26861184 | 50168 | gain | 1773 | | 36.62 | high OR intergenic (OR > 30) | 176 |
| 6 | 26811016 | 26861184 | 50168 | gain | 1807 | | 36.62 | high OR intergenic (OR > 30) | 176 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 6 | 26811016 | 26861184 | 50168 | loss | 1899 | | 36.62 | high OR intergenic (OR > 30) | 176 |
| 6 | 26811016 | 26868404 | 57388 | loss | 1920 | | 36.62 | high OR intergenic (OR > 30) | 178 |
| 6 | 26811016 | 26861184 | 50168 | loss | 1931 | | 36.62 | high OR intergenic (OR > 30) | 176 |
| 6 | 26811016 | 26855591 | 44575 | gain | 2041 | | 36.62 | high OR intergenic (OR > 30) | 180 |
| 6 | 31085482 | 31114029 | 28547 | loss | 1662 | PBMUCL1 | 2.05 | Exon + ve, 5 > ASD > 1, Normals < 2, Sanger − ve | 761 |
| 6 | 31102719 | 31114029 | 11310 | loss | 1849 | PBMUCL1 | 2.95 | Exon + ve, 5 > ASD > 1, Normals < 2, Sanger − ve | 762 |
| 6 | 33400195 | 33511247 | 111052 | loss | 1841 | SYNGAP1 | 11.92 | Intron + ve, ASD > 4, Normals < 2, no Sanger filter applied | 364 |
| 6 | 33491109 | 33507587 | 16478 | loss | 1297 | SYNGAP1 | 11.92 | Intron + ve, ASD > 4, Normals < 2, no Sanger filter applied | 362 |
| 6 | 33491109 | 33505974 | 14865 | loss | 1905 | SYNGAP1 | 11.92 | Intron + ve, ASD > 4, Normals < 2, no Sanger filter applied | 366 |
| 6 | 33491109 | 33505974 | 14865 | loss | 2031 | SYNGAP1 | 11.92 | Intron + ve, ASD > 4, Normals < 2, no Sanger filter applied | 366 |
| 6 | 33492394 | 33505974 | 13580 | loss | 1872 | SYNGAP1 | 11.92 | Intron + ve, ASD > 4, Normals < 2, no Sanger filter applied | 365 |
| 6 | 33492394 | 33505974 | 13580 | loss | 1967 | SYNGAP1 | 11.92 | Intron + ve, ASD > 4, Normals < 2, no Sanger filter applied | 365 |
| 6 | 33495074 | 33505974 | 10900 | loss | 1824 | SYNGAP1 | 11.92 | Intron + ve, ASD > 4, Normals < 2, no Sanger filter applied | 363 |
| 6 | 33495074 | 33505974 | 10900 | loss | 1840 | SYNGAP1 | 11.92 | Intron + ve, ASD > 4, Normals < 2, no Sanger filter applied | 363 |
| 6 | 35846772 | 35878656 | 31884 | loss | 1694 | C6orf27 | 35.04 | Exon + ve, ASD > 4, Normals < 2, no Sanger filter applied | 163 |
| 6 | 35846772 | 35878656 | 31884 | loss | 1694 | C6orf27 | 38.2 | Exon + ve, ASD > 4, Normals < 2, no Sanger filter applied | 163 |
| 6 | 35848099 | 35878656 | 30557 | loss | 1718 | C6orf27 | 35.04 | Exon + ve, ASD > 4, Normals < 2, no Sanger filter applied | 165 |
| 6 | 35848099 | 35878656 | 30557 | loss | 1718 | C6orf27 | 38.2 | Exon + ve, ASD > 4, Normals < 2, no Sanger filter applied | 165 |
| 6 | 35849860 | 35878656 | 28796 | loss | 1680 | C6orf27 | 35.04 | Exon + ve, ASD > 4, Normals < 2, no Sanger filter applied | 162 |
| 6 | 35849860 | 35878656 | 28796 | loss | 1680 | C6orf27 | 38.2 | Exon + ve, ASD > 4, Normals < 2, no Sanger filter applied | 162 |
| 6 | 35851495 | 35872078 | 20583 | loss | 1852 | C6orf27 | 35.04 | Exon + ve, ASD > 4, Normals < 2, no Sanger filter applied | 166 |
| 6 | 35851495 | 35875112 | 23617 | loss | 1950 | C6orf27 | 35.04 | Exon + ve, ASD > 4, Normals < 2, no Sanger filter applied | 169 |
| 6 | 35851495 | 35878656 | 27161 | loss | 1965 | C6orf27 | 35.04 | Exon + ve, ASD > 4, Normals < 2, no Sanger filter applied | 171 |
| 6 | 35851495 | 35878656 | 27161 | loss | 2006 | C6orf27 | 38.2 | Exon + ve, ASD > 4, Normals < 2, no Sanger filter applied | 172 |
| 6 | 35851495 | 35873335 | 21840 | loss | 2018 | C6orf27 | 35.04 | Exon + ve, ASD > 4, Normals < 2, no Sanger filter applied | 171 |
| 6 | 35851495 | 35872078 | 20583 | loss | 1852 | C6orf27 | 38.2 | Exon + ve, ASD > 4, Normals < 2, no Sanger filter applied | 166 |
| 6 | 35851495 | 35875112 | 23617 | loss | 1950 | C6orf27 | 38.2 | Exon + ve, ASD > 4, Normals < 2, no Sanger filter applied | 169 |
| 6 | 35851495 | 35878656 | 27161 | loss | 1965 | C6orf27 | 38.2 | Exon + ve, ASD > 4, Normals < 2, no Sanger filter applied | 171 |
| 6 | 35851495 | 35878656 | 27161 | loss | 2006 | C6orf27 | 38.2 | Exon + ve, ASD > 4, Normals < 2, no Sanger filter applied | 172 |
| 6 | 35851495 | 35873335 | 21840 | loss | 2018 | C6orf27 | 38.2 | Exon + ve, ASD > 4, Normals < 2, no Sanger filter applied | 171 |
| 6 | 35853209 | 35862502 | 9293 | loss | 1940 | C6orf27 | 35.04 | Exon + ve, ASD > 4, Normals < 2, no Sanger filter applied | 189 |
| 6 | 35853209 | 35875112 | 21903 | loss | 1946 | C6orf27 | 35.04 | Exon + ve, ASD > 4, Normals < 2, no Sanger filter applied | 168 |
| 6 | 35853209 | 35873335 | 20126 | loss | 1958 | C6orf27 | 35.04 | Exon + ve, ASD > 4, Normals < 2, no Sanger filter applied | 170 |
| 6 | 35853209 | 35873335 | 20126 | loss | 1961 | C6orf27 | 35.04 | Exon + ve, ASD > 4, Normals < 2, no Sanger filter applied | 170 |
| 6 | 35853209 | 35873335 | 20126 | loss | 1962 | C6orf27 | 35.04 | Exon + ve, ASD > 4, Normals < 2, no Sanger filter applied | 170 |
| 6 | 35853209 | 35873335 | 20126 | loss | 2005 | C6orf27 | 35.04 | Exon + ve, ASD > 4, Normals < 2, no Sanger filter applied | 170 |
| 6 | 35853209 | 35875112 | 21903 | loss | 1946 | C6orf27 | 38.2 | Exon + ve, ASD > 4, Normals < 2, no Sanger filter applied | 168 |
| 6 | 35853209 | 35873335 | 20126 | loss | 1958 | C6orf27 | 38.2 | Exon + ve, ASD > 4, Normals < 2, no Sanger filter applied | 170 |
| 6 | 35853209 | 35873335 | 20126 | loss | 1961 | C6orf27 | 38.2 | Exon + ve, ASD > 4, Normals < 2, no Sanger filter applied | 170 |
| 6 | 35853209 | 35873335 | 20126 | loss | 1962 | C6orf27 | 38.2 | Exon + ve, ASD > 4, Normals < 2, no Sanger filter applied | 170 |
| 6 | 35853209 | 35873335 | 20126 | loss | 2005 | C6orf27 | 38.2 | Exon + ve, ASD > 4, Normals < 2, no Sanger filter applied | 170 |
| 6 | 35855652 | 35873335 | 17683 | loss | 1301 | C6orf27 | 35.04 | Exon + ve, ASD > 4, Normals < 2, no Sanger filter applied | 158 |
| 6 | 35855652 | 35873335 | 17683 | loss | 1837 | C6orf27 | 35.04 | Exon + ve, ASD > 4, Normals < 2, no Sanger filter applied | 158 |
| 6 | 35855652 | 35873335 | 17683 | loss | 1839 | C6orf27 | 35.04 | Exon + ve, ASD > 4, Normals < 2, no Sanger filter applied | 158 |
| 6 | 35855652 | 35873335 | 17683 | loss | 1952 | C6orf27 | 35.04 | Exon + ve, ASD > 4, Normals < 2, no Sanger filter applied | 158 |
| 6 | 35855652 | 35873335 | 17683 | loss | 1959 | C6orf27 | 35.04 | Exon + ve, ASD > 4, Normals < 2, no Sanger filter applied | 158 |
| 6 | 35855652 | 35873335 | 17683 | loss | 1301 | C6orf27 | 38.2 | Exon + ve, ASD > 4, Normals < 2, no Sanger filter applied | 158 |
| 6 | 35855652 | 35873335 | 17683 | loss | 1837 | C6orf27 | 38.2 | Exon + ve, ASD > 4, Normals < 2, no Sanger filter applied | 158 |
| 6 | 35855652 | 35873335 | 17683 | loss | 1839 | C6orf27 | 38.2 | Exon + ve, ASD > 4, Normals < 2, no Sanger filter applied | 158 |
| 6 | 35855652 | 35873335 | 17683 | loss | 1952 | C6orf27 | 38.2 | Exon + ve, ASD > 4, Normals < 2, no Sanger filter applied | 158 |
| 6 | 35855652 | 35873335 | 17683 | loss | 1950 | C6orf27 | 38.2 | Exon + ve, ASD > 4, Normals < 2, no Sanger filter applied | 158 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 6 | 35856922 | 35872078 | 15156 | gain | 1347 | C6orf27 | 35.04 | Exon + ve, ASD > 4, Normals < 2, no Sanger filter applied | 159 |
| 6 | 35856922 | 35873335 | 16413 | gain | 1348 | C6orf27 | 35.04 | Exon + ve, ASD > 4, Normals < 2, no Sanger filter applied | 160 |
| 6 | 35856922 | 35873335 | 16413 | gain | 1530 | C6orf27 | 35.04 | Exon + ve, ASD > 4, Normals < 2, no Sanger filter applied | 160 |
| 6 | 35856922 | 35878656 | 21734 | loss | 1017 | C6orf27 | 35.04 | Exon + ve, ASD > 4, Normals < 2, no Sanger filter applied | 167 |
| 6 | 35856922 | 35872078 | 15156 | gain | 1347 | C6orf27 | 38.2 | Exon + ve, ASD > 4, Normals < 2, no Sanger filter applied | 159 |
| 6 | 35856922 | 35873335 | 16413 | gain | 1348 | C6orf27 | 38.2 | Exon + ve, ASD > 4, Normals < 2, no Sanger filter applied | 160 |
| 6 | 35856922 | 35873335 | 16413 | gain | 1530 | C6orf27 | 38.2 | Exon + ve, ASD > 4, Normals < 2, no Sanger filter applied | 160 |
| 6 | 35856922 | 35878656 | 21734 | loss | 1917 | C6orf27 | 38.2 | Exon + ve, ASD > 4, Normals < 2, no Sanger filter applied | 167 |
| 6 | 35862502 | 35875112 | 12610 | gain | 1414 | C6orf27 | 38.2 | Exon + ve, ASD > 4, Normals < 2, no Sanger filter applied | 161 |
| 6 | 35862502 | 35873335 | 10833 | gain | 1710 | C6orf27 | 38.2 | Exon + ve, ASD > 4, Normals < 2, no Sanger filter applied | 164 |
| 6 | 35862502 | 35873335 | 10833 | gain | 1760 | C6orf27 | 38.2 | Exon + ve, ASD > 4, Normals < 2, no Sanger filter applied | 164 |
| 6 | 78983276 | 79091850 | 108574 | loss | 1449 | | 38.2 | high OR intergenic (OR > 30) | 865 |
| 6 | 78999263 | 79091850 | 92587 | gain | 1662 | | 38.2 | high OR intergenic (OR > 30) | 868 |
| 6 | 79011979 | 79091850 | 79871 | loss | 1502 | | 38.2 | high OR intergenic (OR > 30) | 866 |
| 6 | 79011979 | 79091850 | 79871 | loss | 1722 | | 38.2 | high OR intergenic (OR > 30) | 866 |
| 6 | 79015901 | 79091850 | 75949 | gain | 1744 | | 38.2 | high OR intergenic (OR > 30) | 869 |
| 6 | 79015901 | 79091850 | 75949 | gain | 1689 | | 38.2 | high OR intergenic (OR > 30) | 869 |
| 6 | 79015901 | 79091850 | 75949 | gain | 2037 | | 38.2 | high OR intergenic (OR > 30) | 869 |
| 6 | 79015901 | 79091850 | 75949 | gain | 2045 | | 38.2 | high OR intergenic (OR > 30) | 869 |
| 6 | 79018959 | 79091850 | 72891 | gain | 1220 | | 38.2 | high OR intergenic (OR > 30) | 864 |
| 6 | 79018959 | 79091850 | 72891 | gain | 1241 | | 38.2 | high OR intergenic (OR > 30) | 864 |
| 6 | 79018959 | 79091850 | 72891 | gain | 1274 | | 38.2 | high OR intergenic (OR > 30) | 864 |
| 6 | 79018959 | 79091850 | 72891 | gain | 1279 | | 38.2 | high OR intergenic (OR > 30) | 864 |
| 6 | 79018959 | 79091850 | 72891 | gain | 1446 | | 38.2 | high OR intergenic (OR > 30) | 864 |
| 6 | 79018959 | 79091850 | 72891 | gain | 1496 | | 38.2 | high OR intergenic (OR > 30) | 864 |
| 6 | 79018959 | 79091850 | 72891 | loss | 1534 | | 38.2 | high OR intergenic (OR > 30) | 864 |
| 6 | 79018959 | 79085247 | 66288 | loss | 1555 | | 38.2 | high OR intergenic (OR > 30) | 867 |
| 6 | 79018959 | 79091850 | 72891 | gain | 1687 | | 38.2 | high OR intergenic (OR > 30) | 864 |
| 6 | 79018959 | 79091850 | 72891 | gain | 1698 | | 38.2 | high OR intergenic (OR > 30) | 864 |
| 6 | 79018959 | 79091850 | 72891 | gain | 1712 | | 38.2 | high OR intergenic (OR > 30) | 864 |
| 6 | 79018959 | 79091850 | 72891 | gain | 1757 | | 38.2 | high OR intergenic (OR > 30) | 864 |
| 6 | 79018959 | 79091850 | 72891 | gain | 1774 | | 38.2 | high OR intergenic (OR > 30) | 864 |
| 6 | 79018959 | 79091850 | 72891 | gain | 1817 | | 38.2 | high OR intergenic (OR > 30) | 864 |
| 6 | 79018959 | 79091850 | 72891 | gain | 1950 | | 38.2 | high OR intergenic (OR > 30) | 864 |
| 6 | 79018959 | 79091850 | 72891 | gain | 1965 | | 38.2 | high OR inlergenic (OR > 30) | 864 |
| 6 | 79018959 | 79091850 | 72891 | gain | 2043 | | 38.2 | high OR intergenic (OR > 30) | 864 |
| 6 | 81097222 | 81100756 | 3534 | loss | 1552 | BCKDHB | 7.42 | Intron + ve, ASD > 4, Normals < 2, no Sanger filter applied | 557 |
| 6 | 81097222 | 81114986 | 17764 | gain | 1621 | BCKDHB | 7.42 | Intron + ve, ASD > 4, Normals < 2, no Sanger filter applied | 558 |
| 6 | 81097222 | 81106976 | 9754 | gain | 1707 | BCKDHB | 7.42 | Intron + ve, ASD > 4, Normals < 2, no Sanger filter applied | 559 |
| 6 | 81097222 | 81100756 | 3534 | gain | 1753 | BCKDHB | 7.42 | Intron + ve, ASD > 4, Normals < 2, no Sanger filter applied | 557 |
| 6 | 81097222 | 81102939 | 5717 | gain | 1773 | BCKDHB | 7.42 | Intron + ve, ASD > 4, Normals < 2, no Sanger filter applied | 560 |
| 6 | 88089481 | 88096147 | 6666 | loss | 2034 | C6orf62, GJB7 | 5.92 | Exon + ve, 5 > ASD > 1, Normals < 2, Sanger − ve | 642 |
| 6 | 88089541 | 88096147 | 6606 | loss | 1943 | C6orf62, GJB7 | 5.92 | Exon + ve, 5 > ASD > 1, Normals < 2, Sanger − ve | 641 |
| 6 | 88089541 | 88096147 | 6606 | loss | 1951 | C6orf62, GJB7 | 5.92 | Exon + ve, 5 > ASD > 1, Normals < 2, Sanger − ve | 641 |
| 6 | 88089541 | 88096147 | 6606 | loss | 1964 | C6orf62, GJB7 | 5.92 | Exon + ve, 5 > ASD > 1, Normals < 2, Sanger − ve | 641 |
| 6 | 88896497 | 88923379 | 26882 | gain | 1662 | CNR1 | 4.44 | Exon + ve, 5 > ASD > 1, Normals < 2, Sanger − ve | 697 |
| 6 | 88896497 | 88923379 | 26882 | gain | 1735 | CNR1 | 4.44 | Exon + ve, 5 > ASD > 1, Normals < 2, Sanger − ve | 697 |
| 6 | 88899057 | 88923379 | 24322 | gain | 1899 | CNR1 | 4.44 | Exon + ve, 5 > ASD > 1, Normals < 2, Sanger − ve | 698 |
| 6 | 107108807 | 107111183 | 2376 | gain | 1402 | AIM1 | 4.44 | Exon + ve, 5 > ASD > 1, Normals < 2, Sanger − ve | 699 |
| 6 | 107108807 | 107111183 | 2376 | gain | 1527 | AIM1 | 4.44 | Exon + ve, 5 > ASD > 1, Normals < 2, Sanger − ve | 699 |
| 6 | 107108807 | 107111183 | 2376 | gain | 1710 | AIM1 | 4.44 | Exon + ve, 5 > ASD > 1, Normals < 2, Sanger − ve | 699 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 6 | 118817492 | 119113493 | 296001 | gain | 1511 | C6orf204, BRD7P3 | 4.44 | Exon + ve, 5 > ASD > 1, Normals < 2, Sanger − ve | 561 |
| 6 | 118817492 | 119113493 | 296001 | gain | 1710 | C6orf204, BRD7P3 | 4.44 | Exon + ve, 5 > ASD > 1, Normals < 2, Sanger − ve | 561 |
| 6 | 118817492 | 119113493 | 296001 | gain | 1511 | C6orf204 | 7.42 | Intron + ve, ASD, Normals < 2, no Sanger filter applied | 561 |
| 6 | 118817492 | 119113493 | 296001 | gain | 1710 | C6orf204 | 7.42 | Intron + ve, ASD, Normals < 2, no Sanger filter applied | 561 |
| 6 | 118817492 | 119113493 | 206001 | gain | 1511 | C6orf204, PLN | 2.95 | Exon + ve, 5 > ASD > 1, Normals < 2, Sanger − ve | 561 |
| 6 | 118817492 | 119113493 | 296001 | gain | 1710 | C6orf204, PLN | 2.95 | Exon + ve, 5 > ASD > 1, Normals < 2, Sanger − ve | 561 |
| 6 | 118817492 | 119113493 | 296001 | gain | 1511 | C6orf204 | 4.44 | Exon + ve, 5 > ASD > 1, Normals < 2, Sanger − ve | 561 |
| 6 | 118817492 | 119113493 | 296001 | gain | 1710 | C6orf204 | 4.44 | Exon + ve, 5 > ASD > 1, Normals < 2, Sanger − ve | 561 |
| 6 | 118844331 | 118969193 | 124862 | gain | 1759 | C6orf204, BRD7P3 | 4.44 | Exon + ve, 5 > ASD > 1, Normals < 2, Sanger − ve | 563 |
| 6 | 118844331 | 118969193 | 124862 | gain | 1759 | C6orf204 | 7.42 | Intron + ve, ASD, Normals < 2, no Sanger filter applied | 563 |
| 6 | 118956715 | 118958026 | 1311 | loss | 1565 | C6orf204 | 7.42 | Intron + ve, ASD, Normals < 2, no Sanger filter applied | 562 |
| 6 | 118956715 | 118958026 | 1311 | loss | 1590 | C6orf204 | 7.42 | Intron + ve, ASD, Normals < 2, no Sanger filter applied | 562 |
| 6 | 119007312 | 119168291 | 160979 | gain | 1777 | C6orf204 | 4.44 | Exon + ve, 5 > ASD > 1, Normals < 2, Sanger − ve | 700 |
| 6 | 124469271 | 124509956 | 40685 | gain | 1244 | NKAIN2 | 8.91 | Intron + ve, ASD > 4, Normals < 2, no Sanger filter applied | 452 |
| 6 | 124469271 | 124509956 | 40685 | gain | 1247 | NKAIN2 | 8.91 | Intron + ve, ASD > 4, Normals < 2, no Sanger filter applied | 452 |
| 6 | 124469271 | 124509956 | 40685 | gain | 1277 | NKAIN2 | 8.91 | Intron + ve, ASD > 4, Normals < 2, no Sanger filter applied | 452 |
| 6 | 124469271 | 124509956 | 40685 | gain | 1450 | NKAIN2 | 8.91 | Intron + ve, ASD > 4, Normals < 2, no Sanger filter applied | 452 |
| 6 | 124469271 | 124509956 | 40685 | gain | 1610 | NKAIN2 | 8.91 | Intron + ve, ASD > 4, Normals < 2, no Sanger filter applied | 452 |
| 6 | 124469271 | 124509956 | 40685 | gain | 1880 | NKAIN2 | 8.91 | Intron + ve, ASD > 4, Normals < 2, no Sanger filter applied | 452 |
| 6 | 132745678 | 132752481 | 6803 | loss | 1389 | MOXD1 | 10.41 | Intron + ve, ASD > 4, Normals < 2, no Sanger filter applied | 395 |
| 6 | 132745678 | 132755865 | 10187 | loss | 1540 | MOXD1 | 10.41 | Intron + ve, ASD > 4, Normals < 2, no Sanger filter applied | 396 |
| 6 | 132745678 | 132752481 | 6803 | loss | 1605 | MOXD1 | 10.41 | Intron + ve, ASD > 4, Normals < 2, no Sanger filter applied | 395 |
| 6 | 132748175 | 132752481 | 4306 | loss | 1657 | MOXD1 | 10.41 | Intron + ve, ASD > 4, Normals < 2, no Sanger filter applied | 397 |
| 6 | 132748175 | 132755865 | 7690 | loss | 1729 | MOXD1 | 10.41 | Intron + ve, ASD > 4, Normals < 2, no Sanger filter applied | 398 |
| 6 | 132748175 | 132752481 | 4306 | loss | 1738 | MOXD1 | 10.41 | Intron + ve, ASD > 4, Normals < 2, no Sanger filter applied | 397 |
| 6 | 132748175 | 132752481 | 4306 | loss | 1743 | MOXD1 | 10.41 | Intron + ve, ASD > 4, Normals < 2, no Sanger filter applied | 397 |
| 6 | 134622620 | 134635779 | 13159 | loss | 1224 | SGK1 | 7.42 | Intron + ve, ASD > 4, Normals < 2, no Sanger filter applied | 52 |
| 6 | 134622620 | 134635779 | 13159 | loss | 1708 | SGK1 | 7.42 | Intron + ve, ASD > 4, Normals < 2, no Sanger filter applied | 52 |
| 6 | 134624093 | 134635779 | 11686 | loss | 1576 | SGK1 | 7.42 | Intron + ve, ASD > 4, Normals < 2, no Sanger filter applied | 53 |
| 6 | 134624093 | 134635779 | 11686 | loss | 1667 | SGK1 | 7.42 | Intron + ve, ASD > 4, Normals < 2, no Sanger filter applied | 53 |
| 6 | 134627341 | 134634265 | 6924 | loss | 1665 | SGK1 | 7.42 | Intron + ve, ASD > 4, Normals < 2, no Sanger filter applied | 54 |
| 6 | 139635466 | 139651247 | 15781 | loss | 1401 | TXLNB | 19.51 | Intron + ve, ASD > 4, Normals < 2, no Sanger filter applied | 184 |
| 6 | 139635466 | 139648318 | 12852 | loss | 1403 | TXLNB | 19.51 | Intron + ve, ASD > 4, Normals < 2, no Sanger filter applied | 185 |
| 6 | 139635466 | 139648318 | 12852 | loss | 1895 | TXLNB | 19.51 | Intron + ve, ASD > 4, Normals < 2, no Sanger filter applied | 185 |
| 6 | 139635466 | 139651247 | 15781 | loss | 1401 | TXLNB | 36.62 | Intron + ve, ASD > 4, Normals < 2, no Sanger filter applied | 184 |
| 6 | 139635466 | 139648318 | 12852 | loss | 1403 | TXLNB | 36.62 | Intron + ve, ASD > 4, Normals < 2, no Sanger filter applied | 185 |
| 6 | 139635466 | 139648318 | 12852 | loss | 1895 | TXLNB | 36.62 | Intron + ve, ASD > 4, Normals < 2, no Sanger filter applied | 185 |
| 6 | 139638465 | 139651247 | 12782 | loss | 1387 | TXLNB | 19.51 | Intron + ve, ASD > 4, Normals < 2, no Sanger filter applied | 183 |
| 6 | 139638465 | 139651247 | 12782 | loss | 1396 | TXLNB | 19.51 | Intron + ve, ASD > 4, Normals < 2, no Sanger filter applied | 183 |
| 6 | 139638465 | 139651247 | 12782 | loss | 1696 | TXLNB | 19.51 | Intron + ve, ASD > 4, Normals < 2, no Sanger filter applied | 183 |
| 6 | 139638465 | 139651247 | 12782 | loss | 1387 | TXLNB | 36.62 | Intron + ve, ASD > 4, Normals < 2, no Sanger filter applied | 183 |
| 6 | 139638465 | 139651247 | 12782 | loss | 1396 | TXLNB | 36.62 | Intron + ve, ASD > 4, Normals < 2, no Sanger filter applied | 183 |
| 6 | 139638465 | 139651247 | 12782 | loss | 1696 | TXLNB | 36.62 | Intron + ve, ASD > 4, Normals < 2, no Sanger filter applied | 183 |
| 6 | 139641158 | 139651247 | 10089 | loss | 1372 | TXLNB | 19.51 | Intron + ve, ASD > 4, Normals < 2, no Sanger filter applied | 182 |
| 6 | 139641158 | 139654105 | 12947 | loss | 1432 | TXLNB | 19.51 | Intron + ve, ASD > 4, Normals < 2, no Sanger filter applied | 186 |
| 6 | 139641158 | 139648318 | 7160 | loss | 1572 | TXLNB | 19.51 | Intron + ve, ASD > 4, Normals < 2, no Sanger filter applied | 187 |
| 6 | 139641158 | 139648318 | 7160 | loss | 1616 | TXLNB | 19.51 | Intron + ve, ASD > 4, Normals < 2, no Sanger filter applied | 187 |
| 6 | 139641158 | 139651247 | 10089 | loss | 1864 | TXLNB | 19.51 | Intron + ve, ASD > 4, Normals < 2, no Sanger filter applied | 182 |
| 6 | 139641158 | 139648318 | 7160 | loss | 2040 | TXLNB | 19.51 | Intron + ve, ASD > 4, Normals < 2, no Sanger filter applied | 187 |
| 6 | 139641158 | 139651247 | 10089 | loss | 2042 | TXLNB | 19.51 | Intron + ve, ASD > 4, Normals < 2, no Sanger filter applied | 182 |
| 6 | 139641158 | 139651247 | 10089 | loss | 1372 | TXLNB | 36.62 | Intron + ve, ASD > 4, Normals < 2, no Sanger filter applied | 182 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 6 | 139641158 | 139654105 | 12947 | loss | 1432 | TXLNB | 36.62 | Intron + ve, ASD > 4, Normals < 2, no Sanger filter applied | 186 |
| 6 | 139641158 | 139648318 | 7160 | loss | 1572 | TXLNB | 36.62 | Intron + ve, ASD > 4, Normals < 2, no Sanger filter applied | 187 |
| 6 | 139641158 | 139648318 | 7160 | loss | 1616 | TXLNB | 36.62 | Intron + ve, ASD > 4, Normals < 2, no Sanger filter applied | 187 |
| 6 | 139641158 | 139648318 | 7160 | loss | 1864 | TXLNB | 36.62 | Intron + ve, ASD > 4, Normals < 2, no Sanger filter applied | 187 |
| 6 | 139641158 | 139651247 | 10089 | loss | 2040 | TXLNB | 36.62 | Intron + ve, ASD > 4, Normals < 2, no Sanger filter applied | 182 |
| 6 | 139641158 | 139648318 | 7160 | loss | 2042 | TXLNB | 36.62 | Intron + ve, ASD > 4, Normals < 2, no Sanger filter applied | 187 |
| 6 | 139643729 | 139648318 | 4589 | loss | 1230 | TXLNB | 36.62 | Intron + ve, ASD > 4, Normals < 2, no Sanger filter applied | 181 |
| 6 | 139643729 | 139648318 | 4589 | loss | 1428 | TXLNB | 36.62 | Intron + ve, ASD > 4, Normals < 2, no Sanger filter applied | 181 |
| 6 | 139643729 | 139648318 | 4589 | loss | 1551 | TXLNB | 36.62 | Intron + ve, ASD > 4, Normals < 2, no Sanger filter applied | 181 |
| 6 | 139643729 | 139648318 | 4589 | loss | 1577 | TXLNB | 36.62 | Intron + ve, ASD > 4, Normals < 2, no Sanger filter applied | 181 |
| 6 | 139643729 | 139648318 | 4589 | loss | 1811 | TXLNB | 36.62 | Intron + ve, ASD > 4, Normals < 2, no Sanger filter applied | 181 |
| 6 | 139643729 | 139648318 | 4589 | loss | 1837 | TXLNB | 36.62 | Intron + ve, ASD > 4, Normals < 2, no Sanger filter applied | 181 |
| 6 | 139643729 | 139648318 | 4589 | loss | 1859 | TXLNB | 36.62 | Intron + ve, ASD > 4, Normals < 2, no Sanger filter applied | 181 |
| 6 | 139643729 | 139651247 | 7518 | loss | 1896 | TXLNB | 36.62 | Intron + ve, ASD > 4, Normals < 2, no Sanger filter applied | 188 |
| 6 | 139643729 | 139648318 | 4589 | loss | 1898 | TXLNB | 36.62 | Intron + ve, ASD > 4, Normals < 2, no Sanger filter applied | 181 |
| 6 | 139643729 | 139648318 | 4589 | loss | 1946 | TXLNB | 36.62 | Intron + ve, ASD > 4, Normals < 2, no Sanger filter applied | 181 |
| 6 | 139643729 | 139648318 | 4589 | loss | 2044 | TXLNB | 36.62 | Intron + ve, ASD > 4, Normals < 2, no Sanger filter applied | 181 |
| 6 | 152772611 | 152779853 | 7242 | loss | 1403 | SYNE1 | 7.42 | Exon + ve, ASD > 4, Normals < 2, no Sanger filter applied | 564 |
| 6 | 152772611 | 152776554 | 3943 | loss | 1476 | SYNE1 | 7.42 | Exon + ve, ASD > 4, Normals < 2, no Sanger filter applied | 565 |
| 6 | 152772611 | 152776554 | 3943 | loss | 1538 | SYNE1 | 7.42 | Exon + ve, ASD > 4, Normals < 2, no Sanger filter applied | 565 |
| 6 | 152772611 | 152776554 | 3943 | loss | 1654 | SYNE1 | 7.42 | Exon + ve, ASD > 4, Normals < 2, no Sanger filter applied | 565 |
| 6 | 152772611 | 152776554 | 3943 | loss | 1828 | SYNE1 | 7.42 | Exon + ve, ASD > 4, Normals < 2, no Sanger filter applied | 565 |
| 6 | 168726608 | 168738488 | 11880 | loss | 1556 | SMOC2 | 14.94 | Intron + ve, ASD > 4, Normals < 2, no Sanger filter applied | 40 |
| 6 | 168726608 | 168738488 | 11880 | loss | 1556 | SMOC2 | 10.41 | Intron + ve, ASD > 4, Normals < 2, no Sanger filter applied | 40 |
| 6 | 168728054 | 168730714 | 2660 | loss | 1477 | SMOC2 | 14.94 | Intron + ve, ASD > 4, Normals < 2, no Sanger filter applied | 37 |
| 6 | 168728054 | 168730714 | 2660 | loss | 1495 | SMOC2 | 14.94 | Intron + ve, ASD > 4, Normals < 2, no Sanger filter applied | 37 |
| 6 | 168728054 | 168738488 | 10434 | loss | 1505 | SMOC2 | 14.94 | Intron + ve, ASD > 4, Normals < 2, no Sanger filter applied | 38 |
| 6 | 168728054 | 168730714 | 2660 | loss | 1506 | SMOC2 | 14.94 | Intron + ve, ASD > 4, Normals < 2, no Sanger filter applied | 37 |
| 6 | 168728054 | 168734148 | 6094 | loss | 1527 | SMOC2 | 14.94 | Intron + ve, ASD > 4, Normals < 2, no Sanger filter applied | 30 |
| 6 | 168728054 | 168738488 | 10434 | loss | 1598 | SMOC2 | 14.94 | Intron + ve, ASD > 4, Normals < 2, no Sanger filter applied | 38 |
| 6 | 168728054 | 168738488 | 10434 | loss | 1641 | SMOC2 | 14.94 | Intron + ve, ASD > 4, Normals < 2, no Sanger filter applied | 38 |
| 6 | 168728054 | 168738488 | 10434 | loss | 1647 | SMOC2 | 14.94 | Intron + ve, ASD > 4, Normals < 2, no Sanger filter applied | 38 |
| 6 | 168728054 | 168738488 | 10434 | loss | 1715 | SMOC2 | 14.94 | Intron + ve, ASD > 4, Normals < 2, no Sanger filter applied | 38 |
| 6 | 168728054 | 168734148 | 6094 | loss | 1505 | SMOC2 | 10.41 | Intron + ve, ASD > 4, Normals < 2, no Sanger filter applied | 39 |
| 6 | 168728054 | 168738488 | 10434 | loss | 1527 | SMOC2 | 10.41 | Intron + ve, ASD > 4, Normals < 2, no Sanger filter applied | 38 |
| 6 | 168728054 | 168738488 | 10434 | loss | 1598 | SMOC2 | 10.41 | Intron + ve, ASD > 4, Normals < 2, no Sanger filter applied | 38 |
| 6 | 168728054 | 168738488 | 10434 | loss | 1641 | SMOC2 | 10.41 | Intron + ve, ASD > 4, Normals < 2, no Sanger filter applied | 38 |
| 6 | 168728054 | 168738488 | 10434 | loss | 1647 | SMOC2 | 10.41 | Intron + ve, ASD > 4, Normals < 2, no Sanger filter applied | 38 |
| 6 | 168728054 | 168738488 | 10434 | loss | 1715 | SMOC2 | 10.41 | Intron + ve, ASD > 4, Normals < 2, no Sanger filter applied | 38 |
| 7 | 1037402 | 1047707 | 10305 | loss | 1571 | C7orf50 | 16.46 | Intron + ve, ASD > 4, Normals < 2, no Sanger filter applied | 228 |
| 7 | 1037402 | 1047707 | 10305 | loss | 1699 | C7orf50 | 16.46 | Intron + ve, ASD > 4, Normals < 2, no Sanger filter applied | 228 |
| 7 | 1037402 | 1047707 | 10305 | loss | 1703 | C7orf50 | 16.46 | Intron + ve, ASD > 4, Normals < 2, no Sanger filter applied | 228 |
| 7 | 1037402 | 1047707 | 10305 | loss | 1726 | C7orf50 | 16.46 | Intron + ve, ASD > 4, Normals < 2, no Sanger filter applied | 228 |
| 7 | 1037102 | 1047707 | 10305 | loss | 1797 | C7orf50 | 16.46 | Intron + ve, ASD > 4, Normals < 2, no Sanger filter applied | 228 |
| 7 | 1037402 | 1047707 | 10305 | loss | 1843 | C7orf50 | 16.46 | Intron + ve, ASD > 4, Normals < 2, no Sanger filter applied | 228 |
| 7 | 1037402 | 1047707 | 10305 | loss | 1928 | C7orf50 | 16.46 | Intron + ve, ASD > 4, Normals < 2, no Sanger filter applied | 228 |
| 7 | 1037402 | 1047707 | 10305 | loss | 1960 | C7orf50 | 16.46 | Intron + ve, ASD > 4, Normals < 2, no Sanger filter applied | 228 |
| 7 | 1037402 | 1047707 | 10305 | loss | 1963 | C7orf50 | 16.46 | Intron + ve, ASD > 4, Normals < 2, no Sanger filter applied | 228 |
| 7 | 1037402 | 1047707 | 10305 | loss | 1966 | C7orf50 | 16.46 | Intron + ve, ASD > 4, Normals < 2, no Sanger filter applied | 228 |
| 7 | 1037402 | 1047707 | 10305 | loss | 2032 | C7orf50 | 16.46 | Intron + ve, ASD > 4, Normals < 2, no Sanger filter applied | 228 |
| 7 | 1037402 | 1047707 | 10305 | loss | 1571 | C7orf50 | 19.51 | Intron + ve, ASD > 4, Normals < 2, no Sanger filter applied | 228 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 7 | 1037402 | 1047707 | 10305 | loss | 1600 | C7orf50 | 19.51 | Intron + ve, ASD > 4, Normals < 2, no Sanger filter applied | 228 |
| 7 | 1037402 | 1047707 | 10305 | loss | 1703 | C7orf50 | 19.51 | Intron + ve, ASD > 4, Normals < 2, no Sanger filter applied | 228 |
| 7 | 1037402 | 1047707 | 10305 | loss | 1726 | C7orf50 | 19.51 | Intron + ve, ASD > 4, Normals < 2, no Sanger filter applied | 228 |
| 7 | 1037402 | 1047707 | 10305 | loss | 1797 | C7orf50 | 19.51 | Intron + ve, ASD > 4, Normals < 2, no Sanger filter applied | 228 |
| 7 | 1037402 | 1047707 | 10305 | loss | 1843 | C7orf50 | 19.51 | Intron + ve, ASD > 4, Normals < 2, no Sanger filter applied | 228 |
| 7 | 1037402 | 1047707 | 10305 | loss | 1928 | C7orf50 | 19.51 | Intron + ve, ASD > 4, Normals < 2, no Sanger filter applied | 228 |
| 7 | 1037402 | 1047707 | 10305 | loss | 1960 | C7orf50 | 19.51 | Intron + ve, ASD > 4, Normals < 2, no Sanger filter applied | 228 |
| 7 | 1037402 | 1047707 | 10305 | loss | 1963 | C7orf50 | 19.51 | Intron + ve, ASD > 4, Normals < 2, no Sanger filter applied | 228 |
| 7 | 1037402 | 1047707 | 10305 | loss | 1966 | C7orf50 | 19.51 | Intron + ve, ASD > 4, Normals < 2, no Sanger filter applied | 228 |
| 7 | 1037402 | 1047707 | 10305 | loss | 2032 | C7orf50 | 19.51 | Intron + ve, ASD > 4, Normals < 2, no Sanger filter applied | 228 |
| 7 | 1037402 | 1047707 | 10305 | loss | 1571 | C7orf50 | 25.67 | Intron + ve, ASD > 4, Normals < 2, no Sanger filter applied | 228 |
| 7 | 1037402 | 1047707 | 10305 | loss | 1699 | C7orf50 | 25.67 | Intron + ve, ASD > 4, Normals < 2, no Sanger filter applied | 228 |
| 7 | 1037402 | 1047707 | 10305 | loss | 1703 | C7orf50 | 25.67 | Intron + ve, ASD > 4, Normals < 2, no Sanger filter applied | 228 |
| 7 | 1037402 | 1047707 | 10305 | loss | 1726 | C7orf50 | 25.67 | Intron + ve, ASD > 4, Normals < 2, no Sanger filter applied | 228 |
| 7 | 1037402 | 1047707 | 10305 | loss | 1797 | C7orf30 | 25.67 | Intron + ve, ASD > 4, Normals < 2, no Sanger filter applied | 228 |
| 7 | 1037402 | 1047707 | 10305 | loss | 1843 | C7orf50 | 25.67 | Intron + ve, ASD > 4, Normals < 2, no Sanger filter applied | 228 |
| 7 | 1037402 | 1047707 | 10305 | loss | 1928 | C7orf50 | 25.67 | Intron + ve, ASD > 4, Normals < 2, no Sanger filter applied | 228 |
| 7 | 1037402 | 1047707 | 10305 | loss | 1960 | C7orf50 | 25.67 | Intron + ve, ASD > 4, Normals < 2, no Sanger filter applied | 228 |
| 7 | 1037402 | 1047707 | 10305 | loss | 1963 | C7orf50 | 25.67 | Intron + ve, ASD > 4, Normals < 2, no Sanger filter applied | 228 |
| 7 | 1037402 | 1047707 | 10305 | loss | 1966 | C7orf50 | 25.67 | Intron + ve, ASD > 4, Normals < 2, no Sanger filter applied | 228 |
| 7 | 1037402 | 1047707 | 10305 | loss | 2032 | C7orf50 | 25.67 | Intron + ve, ASD > 4, Normals < 2, no Sanger filter applied | 228 |
| 7 | 1038517 | 1047707 | 9190 | loss | 1416 | C7orf50 | 25.67 | Intron + ve, ASD > 4, Normals < 2, no Sanger filter applied | 227 |
| 7 | 1038517 | 1047707 | 9190 | loss | 1498 | C7orf50 | 25.67 | Intron + ve, ASD > 4, Normals < 2, no Sanger filter applied | 227 |
| 7 | 1038517 | 1047707 | 9190 | loss | 1416 | C7orf50 | 25.67 | Intron + ve, ASD > 4, Normals < 2, no Sanger filter applied | 227 |
| 7 | 1038517 | 1047707 | 9190 | loss | 1498 | C7orf50 | 25.67 | Intron + ve, ASD > 4, Normals < 2, no Sanger filter applied | 227 |
| 7 | 1047636 | 1047707 | 71 | loss | 1225 | C7orf50 | 25.67 | Intron + ve, ASD > 4, Normals < 2, no Sanger filter applied | 226 |
| 7 | 1047636 | 1047707 | 71 | loss | 1635 | C7orf50 | 25.67 | Intron + ve, ASD > 4, Normals < 2, no Sanger filter applied | 226 |
| 7 | 1047636 | 1047707 | 71 | loss | 1672 | C7orf50 | 25.67 | Intron + ve, ASD > 4, Normals < 2, no Sanger filter applied | 226 |
| 7 | 1047636 | 1047707 | 71 | loss | 2018 | C7orf50 | 25.67 | Intron + ve, ASD > 4, Normals < 2, no Sanger filter applied | 226 |
| 7 | 3488309 | 3497686 | 9377 | loss | 1948 | SDK1 | 10.41 | Intron + ve, ASD > 4, Normals < 2, no Sanger filter applied | 401 |
| 7 | 3496005 | 3497686 | 1681 | loss | 1422 | SDK1 | 10.41 | Intron + ve, ASD > 4, Normals < 2, no Sanger filter applied | 399 |
| 7 | 3496005 | 3497686 | 1681 | loss | 1423 | SDK1 | 10.41 | Intron + ve, ASD > 4, Normals < 2, no Sanger filter applied | 399 |
| 7 | 3496005 | 3497686 | 1681 | loss | 1561 | SDK1 | 10.41 | Intron + ve, ASD > 4, Normals < 2, no Sanger filter applied | 399 |
| 7 | 3496005 | 3499937 | 3932 | loss | 1834 | SDK1 | 10.41 | Intron + ve, ASD > 4, Normals < 2, no Sanger filter applied | 400 |
| 7 | 3496005 | 3497686 | 1681 | loss | 1893 | SDK1 | 10.41 | Intron + ve, ASD > 4, Normals < 2, no Sanger filter applied | 399 |
| 7 | 3496005 | 3497686 | 1681 | loss | 1905 | SDK1 | 10.41 | Intron + ve, ASD > 4, Normals < 2, no Sanger filter applied | 399 |
| 7 | 4042651 | 4049103 | 6452 | loss | 1306 | SDK1 | 10.41 | Intron + ve, ASD > 4, Normals < 2, no Sanger filter applied | 402 |
| 7 | 4042651 | 4049103 | 6452 | loss | 1418 | SDK1 | 10.41 | Intron + ve, ASD > 4, Normals < 2, no Sanger filter applied | 402 |
| 7 | 4042651 | 4049103 | 6452 | loss | 1493 | SDK1 | 10.41 | Intron + ve, ASD > 4, Normals < 2, no Sanger filter applied | 402 |
| 7 | 4042651 | 4049103 | 6452 | loss | 1502 | SDK1 | 10.41 | Intron + ve, ASD > 4, Normals < 2, no Sanger filter applied | 402 |
| 7 | 4042651 | 4049103 | 6452 | loss | 1647 | SDK1 | 10.41 | Intron + ve, ASD > 4, Normals < 2, no Sanger filter applied | 402 |
| 7 | 4042651 | 4049103 | 6452 | loss | 1711 | SDK1 | 10.41 | Intron + ve, ASD > 4, Normals < 2, no Sanger filter applied | 402 |
| 7 | 4042651 | 4049103 | 6452 | loss | 1751 | SDK1 | 10.41 | Intron + ve, ASD > 4, Normals < 2, no Sanger filter applied | 402 |
| 7 | 5102197 | 5183556 | 81359 | loss | 1548 | ZNF890P | 2.95 | Exon + ve, 5 > ASD > 1, Normals < 2, Sanger − ve | 763 |
| 7 | 5138605 | 5148416 | 9811 | loss | 1727 | ZNF890P | 2.95 | Exon + ve, 5 > ASD > 1, Normals < 2, Sanger − ve | 764 |
| 7 | 5825981 | 5831318 | 5337 | gain | 1711 | ZNF815 | 2.05 | Exon + ve, 5 > ASD > 1, Normals < 2, Sanger − ve | 765 |
| 7 | 5825981 | 5851216 | 25235 | loss | 1967 | ZNF815 | 2.05 | Exon + ve, 5 > ASD > 1, Normals < 2, Sanger − ve | 766 |
| 7 | 16805635 | 17715252 | 909617 | gain | 1755 | AGR3 | 2.95 | Exon + ve, 5 > ASD > 1, Normals < 2, Sanger − ve | 767 |
| 7 | 16866725 | 16883040 | 16315 | loss | 1835 | AGR3 | 2.05 | Exon + ve, 5 > ASD > 1, Normals < 2, Sanger − ve | 768 |
| 7 | 23802428 | 23809218 | 6790 | loss | 1413 | STK31 | 8.91 | Intron + ve, ASD > 4, Normals < 2, no Sanger filter applied | 453 |
| 7 | 23802428 | 23809218 | 6700 | loss | 1472 | STK31 | 8.91 | Intron + ve, ASD > 4, Normals < 2, no Sanger filter applied | 453 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 7 | 23802428 | 23811096 | 8668 | loss | 1583 | STK31 | 8.91 | Intron + ve, ASD > 4, Normals < 2, no Sanger filter applied | 454 |
| 7 | 23802428 | 23809218 | 6790 | loss | 1584 | STK31 | 8.91 | Intron + ve, ASD > 4, Normals < 2, no Sanger filter applied | 453 |
| 7 | 23802428 | 23802515 | 87 | loss | 1619 | STK31 | 8.91 | Intron + ve, ASD > 4, Normals < 2, no Sanger filter applied | 455 |
| 7 | 23802428 | 23802515 | 87 | loss | 1960 | STK31 | 8.91 | Intron + ve, ASD > 4, Normals < 2, no Sanger filter applied | 455 |
| 7 | 47938912 | 48966480 | 1027568 | loss | 1886 | ABCA13 | 10.41 | Intron + ve, ASD > 4, Normals < 2, no Sanger filter applied | 406 |
| 7 | 48443242 | 48449543 | 6301 | gain | 1223 | ABCA13 | 10.41 | Intron + ve, ASD > 4, Normals < 2, no Sanger filter applied | 403 |
| 7 | 48443242 | 48449543 | 6301 | loss | 1583 | ABCA13 | 10.41 | Intron + ve, ASD > 4, Normals < 2, no Sanger filter applied | 403 |
| 7 | 48443511 | 48449543 | 6032 | gain | 1273 | ABCA13 | 10.41 | Intron + ve, ASD > 4, Normals < 2, no Sanger filter applied | 404 |
| 7 | 48443511 | 48450802 | 7291 | gain | 1615 | ABCA13 | 10.41 | Intron + ve, ASD > 4, Normals < 2, no Sanger filter applied | 405 |
| 7 | 48443511 | 48452957 | 9446 | gain | 1891 | ABCA13 | 10.41 | Intron + ve, ASD > 4, Normals < 2, no Sanger filter applied | 407 |
| 7 | 48443511 | 48449543 | 6032 | gain | 2028 | ABCA13 | 10.41 | Intron + ve, ASD > 4, Normals < 2, no Sanger filter applied | 404 |
| 7 | 62090591 | 62480276 | 389685 | gain | 1567 | LOC100287834, LOC100287704, LOC643955 | 2.95 | Exon + ve, 5 > ASD > 1, Normals < 2, Sanger − ve | 770 |
| 7 | 62252722 | 62563446 | 310724 | gain | 1389 | LOC100287834, LOC100287704, LOC643955 | 2.95 | Exon + ve, 5 > ASD > 1, Normals < 2, Sanger − ve | 769 |
| 7 | 71482849 | 71491600 | 8751 | loss | 1727 | CALN1 | 11.92 | Intron + ve, ASD > 4, Normals < 2, no Sanger filter applied | 368 |
| 7 | 71482849 | 71491600 | 8751 | loss | 1743 | CALN1 | 11.92 | Intron + ve, ASD > 4, Normals < 2, no Sanger filter applied | 368 |
| 7 | 71482849 | 71501309 | 18460 | loss | 1853 | CALN1 | 11.92 | Intron + ve, ASD > 4, Normals < 2, no Sanger filter applied | 369 |
| 7 | 71487316 | 71491600 | 4284 | loss | 1677 | CALN1 | 11.92 | Intron + ve, ASD > 4, Normals < 2, no Sanger filter applied | 367 |
| 7 | 71487316 | 71491600 | 4284 | loss | 1718 | CALN1 | 11.92 | Intron + ve, ASD > 4, Normals < 2, no Sanger filter applied | 367 |
| 7 | 71487316 | 71491600 | 4284 | loss | 1724 | CALN1 | 11.92 | Intron + ve, ASD > 4, Normals < 2, no Sanger filter applied | 367 |
| 7 | 71487316 | 71491600 | 4284 | loss | 1735 | CALN1 | 11.92 | Intron + ve, ASD > 4, Normals < 2, no Sanger filter applied | 367 |
| 7 | 71487316 | 71491600 | 4284 | loss | 1751 | CALN1 | 11.92 | Intron + ve, ASD > 4, Normals < 2, no Sanger filter applied | 367 |
| 7 | 100160244 | 100182350 | 22106 | loss | 2020 | ZAN | 14.94 | Exon + ve, ASD > 4, Normals < 2, no Sanger filter applied | 205 |
| 7 | 100162851 | 100183859 | 21008 | loss | 1227 | ZAN | 14.94 | Exon + ve, ASD > 4, Normals < 2, no Sanger filter applied | 205 |
| 7 | 100162851 | 100183859 | 21008 | loss | 1236 | ZAN | 14.94 | Exon + ve, ASD > 4, Normals < 2, no Sanger Filter applied | 291 |
| 7 | 100162851 | 100182350 | 19499 | loss | 1771 | ZAN | 14.94 | Exon + ve, ASD > 4, Normals < 2, no Sanger filter applied | 292 |
| 7 | 100162851 | 100183859 | 21008 | loss | 1803 | ZAN | 14.94 | Exon + ve, ASD > 4, Normals < 2, no Sanger filter applied | 291 |
| 7 | 100162851 | 100183859 | 21008 | loss | 1824 | ZAN | 14.94 | Exon + ve, ASD > 4, Normals < 2, no Sanger filter applied | 291 |
| 7 | 100162851 | 100183859 | 21008 | loss | 2034 | ZAN | 14.94 | Exon + ve, ASD > 4, Normals < 2, no Sanger filter applied | 291 |
| 7 | 100166257 | 100182350 | 16093 | loss | 1777 | ZAN | 14.94 | Exon + ve, ASD > 4, Normals < 2, no Sanger filter applied | 293 |
| 7 | 100166257 | 100183859 | 17602 | loss | 1896 | ZAN | 14.94 | Exon + ve, ASD > 4, Normals < 2, no Sanger filter applied | 294 |
| 7 | 100166257 | 100182350 | 16093 | loss | 2030 | ZAN | 14.94 | Exon + ve, ASD > 4, Normals < 2, no Sanger filter applied | 293 |
| 7 | 102465042 | 102554005 | 88963 | gain | 1464 | FBXL13 | 2.95 | Exon + ve, 5 > ASD > 1, Normals < 2, Sanger − ve | 701 |
| 7 | 102465042 | 102554005 | 88963 | gain | 1997 | FBXL13 | 2.95 | Exon + ve, 5 > ASD > 1, Normals < 2, Sanger − ve | 701 |
| 7 | 102465042 | 102554005 | 88963 | gain | 1464 | ARMC10, FBXL13 | 4.44 | Exon + ve, 5 > ASD > 1, Normals < 2, Sanger − ve | 701 |
| 7 | 102465042 | 102554005 | 88963 | gain | 1997 | ARMC10, FBXL13 | 4.44 | Exon + ve, 5 > ASD > 1, Normals < 2, Sanger − ve | 701 |
| 7 | 102465042 | 102554005 | 88963 | gain | 1464 | ARMC10, NAPEPLD | 2.95 | Exon + ve, 5 > ASD > 1, Normals < 2, Sanger − ve | 701 |
| 7 | 102465042 | 102554005 | 88963 | gain | 1997 | ARMC10, NAPEPLD | 2.95 | Exon + ve, 5 > ASD > 1, Normals < 2, Sanger − ve | 701 |
| 7 | 102496150 | 102520569 | 24419 | gain | 1848 | ARMC10, FBXL13 | 4.44 | Exon + ve, 5 > ASD > 1, Normals < 2, Sanger − ve | 702 |
| 7 | 104706525 | 104708287 | 1762 | loss | 1286 | SRPK2 | 7.42 | Genic (distinct CNV-subreaions); OR > 6 | 566 |
| 7 | 104706525 | 104708287 | 1762 | loss | 1287 | SRPK2 | 7.42 | Genic (distinct CNV-subregions); OR > 6 | 566 |
| 7 | 104706525 | 104708287 | 1762 | loss | 1774 | SRPK2 | 7.42 | Genic (distinct CNV-subreaions); OR > 6 | 566 |
| 7 | 104706525 | 104708287 | 1762 | loss | 1839 | SRPK2 | 7.42 | Genic (distinct CNV-subreaions); OR > 6 | 566 |
| 7 | 104706525 | 104708287 | 1762 | loss | 1901 | SRPK2 | 7.42 | Genic (distinct CNV-subregions); OR > 6 | 566 |
| 7 | 104760047 | 104764319 | 4272 | loss | 2033 | SRPK2 | 7.42 | Genic (distinct CNV-subregions); OR > 6 | 567 |
| 7 | 108554265 | 108785119 | 230851 | loss | 1234 | | 30.33 | high OR intergenic (OR > 30) | 872 |
| 7 | 108554265 | 108785119 | 230851 | loss | 1256 | | 36.62 | high OR intergenic (OR > 30) | 872 |
| 7 | 108696828 | 108706130 | 9302 | gain | 1285 | | 30.33 | high OK intergenic (OR > 30) | 870 |
| 7 | 108696828 | 108706130 | 9302 | gain | 1306 | | 30.33 | high OR intergenic (OR > 30) | 870 |
| 7 | 108696828 | 108706130 | 9302 | gain | | | 30.33 | high OR intergenic (OR > 30) | 870 |
| 7 | 108696828 | 108706130 | 9302 | gain | | | 30.33 | high OR intergenic (OR > 30) | 870 |
| 7 | 108696828 | 108706130 | 9302 | gain | | | 30.33 | high OR intergenic (OR > 30) | 870 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 7 | 108696828 | 108706130 | 9302 | gain | 1344 | | 30.33 | high OR intergenic (OR > 30) | 870 |
| 7 | 108696828 | 108708143 | 11315 | gain | 1346 | | 30.33 | high OR intergenic (OR > 30) | 874 |
| 7 | 108696828 | 108708143 | 11315 | gain | 1410 | | 30.33 | high OR intergenic (OR > 30) | 874 |
| 7 | 108696828 | 108708143 | 11315 | gain | 1430 | | 30.33 | high OR intergenic (OR > 30) | 874 |
| 7 | 108696828 | 108706130 | 9302 | gain | 1521 | | 30.33 | high OR intergenic (OR > 30) | 870 |
| 7 | 108696828 | 108708143 | 11315 | gain | 1622 | | 30.33 | high OR intergenic (OR > 30) | 874 |
| 7 | 108696828 | 108708143 | 11315 | gain | 1661 | | 30.33 | high OR intergenic (OR > 30) | 874 |
| 7 | 108696828 | 108706130 | 9302 | gain | 1704 | | 30.33 | high OR intergenic (OR > 30) | 870 |
| 7 | 108696828 | 108708143 | 11315 | gain | 1792 | | 30.33 | high OR intergenic (OR > 30) | 874 |
| 7 | 108696828 | 108706130 | 9302 | gain | 1813 | | 30.33 | high OR intergenic (OR > 30) | 870 |
| 7 | 108696828 | 108708143 | 11315 | gain | 1908 | | 30.33 | high OR intergenic (OR > 30) | 874 |
| 7 | 108696828 | 108706130 | 9302 | gain | 1950 | | 30.33 | high OR intergenic (OR > 30) | 870 |
| 7 | 108696828 | 108708143 | 11315 | gain | 1970 | | 30.33 | high OR intergenic (OR > 30) | 874 |
| 7 | 108696828 | 108706130 | 9302 | gain | 2028 | | 30.33 | high OR intergenic (OR > 30) | 870 |
| 7 | 108696828 | 108708143 | 11315 | gain | 2031 | | 30.33 | high OR intergenic (OR > 30) | 874 |
| 7 | 108696828 | 108706130 | 9302 | gain | 1234 | | 36.62 | high OR intergenic (OR > 30) | 870 |
| 7 | 108696828 | 108706130 | 9302 | gain | 1256 | | 36.62 | high OR intergenic (OR > 30) | 870 |
| 7 | 108696828 | 108706130 | 9302 | gain | 1285 | | 36.62 | high OR intergenic (OR > 30) | 870 |
| 7 | 108696828 | 108706130 | 9302 | gain | 1306 | | 36.62 | high OR intergenic (OR > 30) | 870 |
| 7 | 108696828 | 108706130 | 9302 | gain | 1344 | | 36.62 | high OR intergenic (OR > 30) | 870 |
| 7 | 108696828 | 108708143 | 11315 | gain | 1346 | | 36.62 | high OR intergenic (OR > 30) | 874 |
| 7 | 108696828 | 108708143 | 11315 | gain | 1410 | | 36.62 | high OR intergenic (OR > 30) | 874 |
| 7 | 108696828 | 108708143 | 11315 | gain | 1430 | | 36.62 | high OR intergenic (OR > 30) | 874 |
| 7 | 108696828 | 108706130 | 9302 | gain | 1521 | | 36.62 | high OR intergenic (OR > 30) | 870 |
| 7 | 108696828 | 108708143 | 11315 | gain | 1622 | | 36.62 | high OR intergenic (OR > 30) | 874 |
| 7 | 108696828 | 108708143 | 11315 | gain | 1661 | | 36.62 | high OR intergenic (OR > 30) | 874 |
| 7 | 108696828 | 108706130 | 9302 | gain | 1704 | | 36.62 | high OR intergenic (OR > 30) | 870 |
| 7 | 108696828 | 108708143 | 11315 | gain | 1792 | | 36.62 | high OR intergenic (OR > 30) | 874 |
| 7 | 108696828 | 108706130 | 9302 | gain | 1813 | | 36.62 | high OR intergenic (OR > 30) | 870 |
| 7 | 108696828 | 108708143 | 11315 | gain | 1908 | | 36.62 | high OR intergenic (OR > 30) | 874 |
| 7 | 108696828 | 108706130 | 9302 | gain | 1950 | | 36.62 | high OR intergenic (OR > 30) | 870 |
| 7 | 108696828 | 108708143 | 11315 | gain | 1970 | | 36.62 | high OR intergenic (OR > 30) | 874 |
| 7 | 108696828 | 108706130 | 9302 | gain | 2028 | | 36.62 | high OR intergenic (OR > 30) | 870 |
| 7 | 108696828 | 108708143 | 11315 | gain | 2031 | | 36.62 | high OR intergenic (OR > 30) | 874 |
| 7 | 108700255 | 108706130 | 5875 | gain | 1267 | | 36.62 | high OR intergenic (OR > 30) | 871 |
| 7 | 108700255 | 108708143 | 7888 | gain | 1304 | | 36.62 | high OR intergenic (OR > 30) | 873 |
| 7 | 108700255 | 108706130 | 5875 | gain | 1423 | | 36.62 | high OR intergenic (OR > 30) | 871 |
| 7 | 108700255 | 108708143 | 7888 | gain | 1620 | | 36.62 | high OR intergenic (OR > 30) | 873 |
| 7 | 118609124 | 118645208 | 36084 | gain | 1612 | | 30.33 | high OR intergenic (OR > 30) | 883 |
| 7 | 118618468 | 118622742 | 4274 | gain | 1222 | | 30.33 | high OR intergenic (OR > 30) | 880 |
| 7 | 118618468 | 118645208 | 26740 | gain | 1323 | | 30.33 | high OR intergenic (OR > 30) | 881 |
| 7 | 118618468 | 118622742 | 4274 | gain | 1374 | | 30.33 | high OR intergenic (OR > 30) | 880 |
| 7 | 118618468 | 118633999 | 15531 | gain | 1485 | | 30.33 | high OR intergenic (OR > 30) | 882 |
| 7 | 118618468 | 118645208 | 26740 | gain | 1533 | | 30.33 | high OR intergenic (OR > 30) | 881 |
| 7 | 118618468 | 118622742 | 4274 | gain | 1543 | | 30.33 | high OR intergenic (OR > 30) | 880 |
| 7 | 118618468 | 118622742 | 1274 | gain | 1568 | | 30.33 | high OR intergenic (OR > 30) | 880 |
| 7 | 118618468 | 118622742 | 4274 | gain | 1601 | | 30.33 | high OK intergenic (OR > 30) | 880 |
| 7 | 118618468 | 118633999 | 15531 | gain | 1616 | | 30.33 | high OR intergenic (OR > 30) | 882 |
| 7 | 118618468 | 118622742 | 4274 | gain | 1635 | | 30.33 | high OR intergenic (OR > 30) | 880 |
| 7 | 118618468 | 118622742 | 4274 | gain | 1665 | | 30.33 | high OR intergenic (OR > 30) | 880 |
| 7 | 118618468 | 118633999 | 15531 | gain | 1740 | | 30.33 | high OR intergenic (OR > 30) | 882 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 7 | 118618468 | 118622742 | 4274 | gain | 1766 | | 30.33 | high OR intergenic (OR > 30) | 880 |
| 7 | 118618468 | 118622742 | 4274 | gain | 1783 | | 30.33 | high OR intergenic (OR > 30) | 880 |
| 7 | 118618468 | 118622742 | 4274 | gain | 1834 | | 30.33 | high OR intergenic (OR > 30) | 880 |
| 7 | 118618468 | 118622742 | 4274 | gain | 1876 | | 30.33 | high OR intergenic (OR > 30) | 880 |
| 7 | 118618468 | 118622742 | 4274 | gain | 1921 | | 30.33 | high OR intergenic (OR > 30) | 880 |
| 7 | 118618468 | 118622742 | 4274 | gain | 1926 | | 30.33 | high OR intergenic (OR > 30) | 880 |
| 7 | 118618468 | 118622742 | 4274 | gain | 2030 | | 30.33 | high OR intergenic (OR > 30) | 880 |
| 7 | 141408013 | 141446728 | 38715 | gain | 1225 | MGAM | 7.42 | Exon + ve, ASD > 4, Normals < 2, no Sanger filter applied | 568 |
| 7 | 141408013 | 141446728 | 38715 | gain | 1720 | MGAM | 7.42 | Exon + ve, ASD > 4, Normals < 2, no Sanger filter applied | 568 |
| 7 | 141408013 | 141446728 | 38715 | gain | 1225 | MGAM | 4.44 | Exon + ve, ASD > 5 > ASD > 1, Normals < 2, Sanger – ve | 568 |
| 7 | 141408013 | 141446728 | 38715 | gain | 1720 | MGAM | 4.44 | Exon + ve, ASD > 5 > ASD > 1, Normals < 2, Sanger – ve | 568 |
| 7 | 141410894 | 141443577 | 32683 | gain | 1691 | MGAM | 7.42 | Exon + ve, ASD > 4, Normals < 2, no Sanger filter applied | 569 |
| 7 | 141410894 | 141442231 | 31337 | gain | 1734 | MGAM | 7.42 | Exon + ve, ASD > 4, Normals < 2, no Sanger filter applied | 570 |
| 7 | 141410894 | 141443577 | 32683 | gain | 1691 | MGAM | 4.44 | Exon + ve, ASD > 5 > ASD > 1, Normals < 2, Sanger – ve | 569 |
| 7 | 141413352 | 141442231 | 28879 | gain | 1897 | MGAM | 7.42 | Exon + ve, ASD > 4, Normals < 2, no Sanger filter applied | 571 |
| 7 | 141953817 | 142205830 | 252013 | loss | 1232 | PRSS1 | 46.2 | Genic (distinct CNV-subregions); OR > 6 | 102 |
| 7 | 141953817 | 142205830 | 252013 | loss | 1232 | PRSS2 | 18.1 | Genic (distinct CNV-subregions); OR > 6 | 102 |
| 7 | 141989750 | 142205830 | 216080 | loss | 1803 | PRSS1 | 46.2 | Exon + ve, ASD > 4, Normals < 2, no Sanger filter applied | 117 |
| 7 | 141989750 | 142205830 | 216080 | loss | 1803 | PRSS2 | 18.1 | Genic (distinct CNV-subregions); OR > 6 | 117 |
| 7 | 141993718 | 142207147 | 213429 | loss | 1930 | PRSS1 | 46.2 | Exon + ve, ASD > 4, Normals < 2, no Sanger filter applied | 123 |
| 7 | 141993718 | 142207147 | 213429 | loss | 1930 | PRSS2 | 18.1 | Genic (distinct CNV-subregions); OR > 6 | 123 |
| 7 | 142005505 | 142152205 | 146700 | loss | 1601 | PRSS1 | 46.2 | Exon + ve, ASD > 4, Normals < 2, no Sanger filter applied | 109 |
| 7 | 142007171 | 142152205 | 145034 | loss | 1242 | PRSS1 | 46.2 | Exon + ve, ASD > 4, Normals < 2, no Sanger filter applied | 103 |
| 7 | 142009000 | 142140540 | 131540 | loss | 2018 | PRSS1 | 46.2 | Exon + ve, ASD > 4, Normals < 2, no Sanger filter applied | 125 |
| 7 | 142009000 | 142205830 | 196830 | loss | 2024 | PRSS1 | 46.2 | Exon + ve, ASD > 4, Normals < 2, no Sanger filter applied | 126 |
| 7 | 142009000 | 142205830 | 196830 | loss | 2024 | PRSS2 | 18.1 | Genic (distinct CNV-subregions); OR > 6 | 126 |
| 7 | 142018368 | 142152205 | 133837 | loss | 1349 | PRSS1 | 46.2 | Exon + ve, ASD > 4, Normals < 2, no Sanger filter applied | 105 |
| 7 | 142018368 | 142152205 | 133837 | loss | 1374 | PRSS1 | 46.2 | Exon + ve, ASD > 4, Normals < 2, no Sanger filter applied | 105 |
| 7 | 142018368 | 142152205 | 133837 | loss | 1697 | PRSS1 | 46.2 | Exon + ve, ASD > 4, Normals < 2, no Sanger filter applied | 105 |
| 7 | 142018368 | 142202274 | 183906 | loss | 1784 | PRSS1 | 46.2 | Exon + ve, ASD > 4, Normals < 2, no Sanger filter applied | 115 |
| 7 | 142018368 | 142202274 | 183906 | loss | 1784 | PRSS2 | 18.1 | Genic (distinct CNV-subregions); OR > 6 | 115 |
| 7 | 142021348 | 142152205 | 130857 | loss | 1347 | PRSS1 | 46.2 | Exon + ve, ASD > 4, Normals < 2, no Sanger filter applied | 104 |
| 7 | 142027745 | 142152205 | 124460 | loss | 1568 | PRSS1 | 46.2 | Exon + ve, ASD > 4, Normals < 2, no Sanger filter applied | 107 |
| 7 | 142027745 | 142152205 | 124460 | loss | 1753 | PRSS1 | 46.2 | Exon + ve, ASD > 4, Normals < 2, no Sanger filter applied | 107 |
| 7 | 142041787 | 142205830 | 164043 | loss | 1837 | PRSS1 | 46.2 | Exon + ve, ASD > 4, Normals < 2, no Sanger filter applied | 119 |
| 7 | 142041787 | 142205830 | 164043 | loss | 1837 | PRSS2 | 18.1 | Genic (distinct CNV-subregions); OR > 6 | 119 |
| 7 | 142083555 | 142205830 | 122275 | loss | 1884 | PRSS1 | 46.2 | Exon + ve, ASD > 4, Normals < 2, no Sanger filter applied | 122 |
| 7 | 142083555 | 142205830 | 122275 | loss | 1884 | PRSS2 | 18.1 | Genic (distinct CNV-subregions); OR > 6 | 122 |
| 7 | 142085047 | 142205830 | 120783 | loss | 1780 | PRSS1 | 46.2 | Exon + ve, ASD > 4, Normals < 2, no Sanger filter applied | 114 |
| 7 | 142085047 | 142205830 | 120783 | loss | 1780 | PRSS2 | 18.1 | Genic (distinct CNV-subregions); OR > 6 | 114 |
| 7 | 142086589 | 142218998 | 132409 | loss | 1660 | PRSS1 | 46.2 | Exon + ve, ASD > 4, Normals < 2, no Sanger filter applied | 111 |
| 7 | 142086589 | 142207147 | 120558 | loss | 1844 | PRSS1 | 46.2 | Exon + ve, ASD > 4, Normals < 2, no Sanger filter applied | 120 |
| 7 | 142086589 | 142218998 | 132409 | loss | 1660 | PRSS2 | 18.1 | Genic (distinct CNV-subregions); OR > 6 | 111 |
| 7 | 142086589 | 142207147 | 120558 | loss | 1844 | PRSS2 | 18.1 | Genic (distinct CNV-subregions); OR > 6 | 120 |
| 7 | 142090029 | 142205830 | 115801 | loss | 1793 | PRSS1 | 46.2 | Exon + ve, ASD > 4, Normals < 2, no Sanger filter applied | 116 |
| 7 | 142090029 | 142167908 | 77879 | loss | 1867 | PRSS1 | 46.2 | Exon + ve, ASD > 4, Normals < 2, no Sanger filter applied | 121 |
| 7 | 142090029 | 142205830 | 115801 | loss | 1793 | PRSS2 | 18.1 | Genic (distinct CNV-subregions); OR > 6 | 116 |
| 7 | 142097873 | 142196001 | 98138 | loss | 1604 | PRSS1 | 46.2 | Exon + ve, ASD > 4, Normals < 2, no Sanger filter applied | 110 |
| 7 | 142097873 | 142152205 | 54332 | loss | 1720 | PRSS1 | 46.2 | Exon + ve, ASD > 4, Normals < 2, no Sanger filter applied | 113 |
| 7 | 142097873 | 142205830 | 107957 | loss | 1830 | PRSS1 | 46.2 | Exon + ve, ASD > 4, Normals < 2, no Sanger filter applied | 118 |
| 7 | 142097873 | 142205830 | 107957 | loss | 1921 | PRSS1 | 46.2 | Exon + ve, ASD > 4, Normals < 2, no Sanger filter applied | 118 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 7 | 142097873 | 142152205 | 54332 | loss | 2041 | PRSS1 | 46.2 | Exon + ve, ASD > 4, Normals < 2, no Sanger filter applied | 113 |
| 7 | 142097873 | 142196001 | 98138 | loss | 1604 | PRSS2 | 18.1 | Genic (distinct CNV-subregions); OR > 6 | 110 |
| 7 | 142097873 | 142205830 | 107957 | loss | 1830 | PRSS2 | 18.1 | Genic (distinct CNV-subregions); OR > 6 | 118 |
| 7 | 142097873 | 142205830 | 107957 | loss | 1921 | PRSS2 | 18.1 | Genic (distinct CNV-subregions); OR > 6 | 118 |
| 7 | 142103597 | 142152205 | 48608 | loss | 1573 | PRSS1 | 46.2 | Exon + ve, ASD > 4, Normals < 2, no Sanger filter applied | 108 |
| 7 | 142103597 | 142205830 | 102233 | loss | 1937 | PRSS2 | 18.1 | Genic (distinct CNV-subregions); OR > 6 | 124 |
| 7 | 142103597 | 142205830 | 102233 | loss | 1937 | PRSS1 | 46.2 | Exon + ve, ASD > 4, Normals < 2, no Sanger filter applied | 124 |
| 7 | 142135117 | 142167901 | 32784 | loss | 1386 | PRSS1 | 46.2 | Exon + ve, ASD > 4, Normals < 2, no Sanger filter applied | 106 |
| 7 | 142136345 | 142176074 | 39729 | loss | 1667 | PRSS1 | 46.2 | Exon + ve, ASD > 4, Normals < 2, no Sanger filter applied | 112 |
| 7 | 142149857 | 142205830 | 55973 | loss | 1824 | PRSS2 | 18.1 | Genic (distinct CNV-subregions); OR > 6 | 250 |
| 7 | 142152205 | 142205830 | 53625 | loss | 1308 | PRSS2 | 18.1 | Genic (distinct CNV-subregions); OR > 6 | 245 |
| 7 | 142156165 | 142187073 | 30908 | gain | 1446 | PRSS2 | 18.1 | Genic (distinct CNV-subregions); OR > 6 | 247 |
| 7 | 142156165 | 142187097 | 30932 | gain | 1694 | PRSS2 | 18.1 | Genic (distinct CNV-subregions); OR > 6 | 249 |
| 7 | 142156165 | 142187097 | 30932 | gain | 1794 | PRSS2 | 18.1 | Genic (distinct CNV-subregions); OR > 6 | 249 |
| 7 | 142156165 | 142187097 | 30932 | gain | 1997 | PRSS2 | 18.1 | Genic (distinct CNV-subregions); OR > 6 | 249 |
| 7 | 142167908 | 142205830 | 37922 | loss | 1845 | PRSS2 | 18.1 | Genic (distinct CNV-subregions); OR > 6 | 251 |
| 7 | 142167908 | 142205830 | 37922 | loss | 1897 | PRSS2 | 18.1 | Genic (distinct CNV-subregions); OR > 6 | 251 |
| 7 | 142176074 | 142205830 | 29756 | loss | 1242 | PRSS2 | 18.1 | Genic (distinct CNV-subregions); OR > 6 | 244 |
| 7 | 142176074 | 112108576 | 22302 | loss | 1347 | PRSS2 | 18.1 | Genic (distinct CNV-subregions); OR > 6 | 246 |
| 7 | 142176074 | 142205830 | 29756 | loss | 1391 | PRSS2 | 18.1 | Genic (distinct CNV-subregions); OR > 6 | 244 |
| 7 | 142176074 | 142205830 | 29756 | loss | 1392 | PRSS2 | 18.1 | Genic (distinct CNV-subregions); OR > 6 | 244 |
| 7 | 142176074 | 142205830 | 29756 | loss | 1401 | PRSS2 | 18.1 | Genic (distinct CNV-subregions); OR > 6 | 244 |
| 7 | 142176074 | 142205830 | 29756 | loss | 1465 | PRSS2 | 18.1 | Genic (distinct CNV-subregions); OR > 6 | 244 |
| 7 | 142176074 | 142207147 | 31073 | loss | 1532 | PRSS2 | 18.1 | Genic (distinct CNV-subregions); OR > 6 | 248 |
| 7 | 142176074 | 142205830 | 29756 | loss | 1568 | PRSS2 | 18.1 | Genic (distinct CNV-subregions); OR > 6 | 244 |
| 7 | 142176074 | 142198376 | 22302 | loss | 1601 | PRSS2 | 18.1 | Genic (distinct CNV-subregions); OR > 6 | 246 |
| 7 | 142176074 | 142205830 | 29756 | loss | 1621 | PRSS2 | 18.1 | Genic (distinct CNV-subregions); OR > 6 | 244 |
| 7 | 142176074 | 142205830 | 29756 | loss | 1622 | PRSS2 | 18.1 | Genic (distinct CNV-subregions); OR > 6 | 244 |
| 7 | 142176074 | 142205830 | 29756 | loss | 1638 | PRSS2 | 18.1 | Genic (distinct CNV-subregions); OR > 6 | 244 |
| 7 | 142176074 | 142207147 | 31073 | loss | 1640 | PRSS2 | 18.1 | Genic (distinct CNV-subregions); OR > 6 | 248 |
| 7 | 142176074 | 142205830 | 29756 | loss | 1697 | PRSS2 | 18.1 | Genic (distinct CNV-subregions); OR > 6 | 244 |
| 7 | 142176074 | 142205830 | 29756 | loss | 1752 | PRSS2 | 18.1 | Genic (distinct CNV-subregions); OR > 6 | 244 |
| 7 | 142176074 | 142205830 | 29756 | loss | 1753 | PRSS2 | 18.1 | Genic (distinct CNV-subregions); OR > 6 | 244 |
| 7 | 142176074 | 142205830 | 29756 | loss | 1788 | PRSS2 | 18.1 | Genic (distinct CNV-subregions); OR > 6 | 244 |
| 7 | 142176074 | 142205830 | 29756 | loss | 1806 | PRSS2 | 18.1 | Genic (distinct CNV-subregions); OR > 6 | 244 |
| 7 | 142176074 | 142205830 | 29756 | loss | 1838 | PRSS2 | 18.1 | Genic (distinct CNV-subregions); OR > 6 | 244 |
| 7 | 142176074 | 20756 | 20756 | loss | 1894 | PRSS2 | 18.1 | Genic (distinct CNV-subregions); OR > 6 | 248 |
| 7 | 142176074 | 142205830 | 29756 | loss | 1914 | PRSS2 | 18.1 | Genic (distinct CNV-subregions); OR > 6 | 244 |
| 7 | 142176074 | 142205830 | 29756 | loss | 2018 | PRSS2 | 18.1 | Genic (distinct CNV-subregions); OR > 6 | 244 |
| 7 | 142176074 | 142205830 | 2906 | loss | 2020 | PRSS2 | 18.1 | Genic (distinct CNV-subregions); OR > 6 | 244 |
| 7 | 145855888 | 145885711 | 29823 | gain | 1236 | CNTNAP2 | 7.42 | Intron + ve, ASD > 4, Normals < 2, no Sanger filter applied | 572 |
| 7 | 145855888 | 145885711 | 29823 | gain | 1718 | CNTNAP2 | 7.42 | Intron + ve, ASD > 4, Normals < 2, no Sanger filter applied | 572 |
| 7 | 145855888 | 145887768 | 31880 | gain | 1752 | CNTNAP2 | 7.42 | Intron + ve, ASD > 4, Normals < 2, no Sanger filter applied | 573 |
| 7 | 145855888 | 145885711 | 29823 | gain | 1762 | CNTNAP2 | 7.42 | Intron + ve, ASD > 4, Normals < 2, no Sanger filter applied | 572 |
| 7 | 145855888 | 145998282 | 142394 | gain | 1871 | CNTNAP2 | 7.42 | Intron + ve, ASD > 4, Normals < 2, no Sanger filter applied | 574 |
| 7 | 145855888 | 145885711 | 29823 | gain | 1236 | CNTNAP2 | 7.42 | Intron + ve, ASD > 4, Normals < 2, no Sanger filter applied | 572 |
| 7 | 145855888 | 145885711 | 29823 | gain | 1718 | CNTNAP2 | 7.42 | Intron + ve, ASD > 4, Normals < 2, no Sanger filter applied | 572 |
| 7 | 145855888 | 145887768 | 31880 | gain | 1752 | CNTNAP2 | 7.42 | Intron + ve, ASD > 4, Normals < 2, no Sanger filter applied | 573 |
| 7 | 145855888 | 145885711 | 29823 | gain | 1762 | CNTNAP2 | 7.42 | Intron + ve, ASD > 4, Normals < 2, no Sanger filter applied | 572 |
| 7 | 145855888 | 145998282 | 142394 | gain | 1871 | CNTNAP2 | 7.42 | Intron + ve, ASD > 4, Normals < 2, no Sanger filter applied | 574 |
| 7 | 145855888 | 145885711 | 29823 | gain | 1236 | CNTNAP2 | 7.42 | Intron + ve, ASD > 4, Normals < 2, no Sanger filter applied | 572 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 7 | 145855888 | 145885711 | 29823 | gain | 1718 | CNTNAP2 | 7.42 | Intron + ve, ASD > 4, Normals < 2, no Sanger filter applied | 572 |
| 7 | 145855888 | 145887768 | 31880 | gain | 1752 | CNTNAP2 | 7.42 | Intron + ve, ASD > 4, Normals < 2, no Sanger filter applied | 573 |
| 7 | 145855888 | 145885711 | 29823 | gain | 1762 | CNTNAP2 | 7.42 | Intron + ve, ASD > 4, Normals < 2, no Sanger filter applied | 572 |
| 7 | 145855888 | 145998282 | 142394 | gain | 1871 | CNTNAP2 | 7.42 | Intron + ve, ASD > 4, Normals < 2, no Sanger filter applied | 574 |
| 7 | 147702365 | 147710037 | 7672 | loss | 1728 | CNTNAP2 | 64.22 | Intron + ve, ASD > 4, Normals < 2, no Sanger filter applied | 74 |
| 7 | 147704200 | 147710037 | 5837 | loss | 1227 | CNTNAP2 | 64.22 | Intron + ve, ASD > 4, Normals < 2, no Sanger filter applied | 70 |
| 7 | 147704200 | 147710037 | 5837 | loss | 1346 | CNTNAP2 | 64.22 | Intron + ve, ASD > 4, Normals < 2, no Sanger filter applied | 70 |
| 7 | 147704200 | 147711471 | 7271 | gain | 1423 | CNTNAP2 | 64.22 | Intron + ve, ASD > 4, Normals < 2, no Sanger filter applied | 73 |
| 7 | 147704200 | 147710037 | 5837 | loss | 1517 | CNTNAP2 | 64.22 | Intron + ve, ASD > 4, Normals < 2, no Sanger filter applied | 70 |
| 7 | 147704200 | 147710037 | 5837 | loss | 1621 | CNTNAP2 | 64.22 | Intron + ve, ASD > 4, Normals < 2, no Sanger filter applied | 70 |
| 7 | 147704200 | 147710037 | 5837 | loss | 1636 | CNTNAP2 | 64.22 | Intron + ve, ASD > 4, Normals < 2, no Sanger filter applied | 70 |
| 7 | 147704200 | 147710037 | 5837 | loss | 1639 | CNTNAP2 | 64.22 | Intron + ve, ASD > 4, Normals < 2, no Sanger filter applied | 70 |
| 7 | 147704200 | 147710037 | 5837 | loss | 1645 | CNTNAP2 | 64.22 | Intron + ve, ASD > 4, Normals < 2, no Sanger filter applied | 70 |
| 7 | 147704200 | 147710037 | 5837 | loss | 1670 | CNTNAP2 | 64.22 | Intron + ve, ASD > 4, Normals < 2, no Sanger filter applied | 70 |
| 7 | 147704200 | 147710037 | 5837 | loss | 1727 | CNTNAP2 | 64.22 | Intron + ve, ASD > 4, Normals < 2, no Sanger filter applied | 70 |
| 7 | 147704200 | 147710037 | 5837 | loss | 1753 | CNTNAP2 | 64.22 | Intron + ve, ASD > 4, Normals < 2, no Sanger filter applied | 70 |
| 7 | 147704200 | 147710037 | 5837 | loss | 1754 | CNTNAP2 | 64.22 | Intron + ve, ASD > 4, Normals < 2, no Sanger filter applied | 70 |
| 7 | 147704200 | 147710037 | 5837 | loss | 1761 | CNTNAP2 | 64.22 | Intron + ve, ASD > 4, Normals < 2, no Sanger filter applied | 70 |
| 7 | 147704200 | 147710037 | 5837 | loss | 1792 | CNTNAP2 | 64.22 | Intron + ve, ASD > 4, Normals < 2, no Sanger filter applied | 70 |
| 7 | 147704200 | 147710037 | 5837 | loss | 1806 | CNTNAP2 | 64.22 | Intron + ve, ASD > 4, Normals < 2, no Sanger filter applied | 70 |
| 7 | 147704200 | 147710037 | 5837 | loss | 1820 | CNTNAP2 | 64.22 | Intron + ve, ASD > 4, Normals < 2, no Sanger filter applied | 70 |
| 7 | 147704200 | 147710037 | 5837 | loss | 1826 | CNTNAP2 | 64.22 | Intron + ve, ASD > 4, Normals < 2, no Sanger filter applied | 70 |
| 7 | 147704200 | 147710037 | 5837 | loss | 1836 | CNTNAP2 | 64.22 | Intron + ve, ASD > 4, Normals < 2, no Sanger filter applied | 70 |
| 7 | 147704200 | 147710037 | 5837 | loss | 1854 | CNTNAP2 | 64.22 | Intron + ve, ASD > 4, Normals < 2, no Sanger filter applied | 70 |
| 7 | 147704200 | 147710037 | 5837 | loss | 1867 | CNTNAP2 | 64.22 | Intron + ve, ASD > 4, Normals < 2, no Sanger filter applied | 70 |
| 7 | 147704200 | 147710037 | 5837 | loss | 1872 | CNTNAP2 | 64.22 | Intron + ve, ASD > 4, Normals < 2, no Sanger filter applied | 70 |
| 7 | 147704200 | 147710037 | 5837 | loss | 1916 | CNTNAP2 | 64.22 | Intron + ve, ASD > 4, Normals < 2, no Sanger filter applied | 70 |
| 7 | 147704200 | 147710037 | 5837 | loss | 1918 | CNTNAP2 | 64.22 | Intron + ve, ASD > 4, Normals < 2, no Sanger filter applied | 70 |
| 7 | 147704200 | 147710037 | 5837 | loss | 1960 | CNTNAP2 | 64.22 | Intron + ve, ASD > 4, Normals < 2, no Sanger filter applied | 70 |
| 7 | 147704200 | 147710037 | 5837 | loss | 2003 | CNTNAP2 | 64.22 | Intron + ve, ASD > 4, Normals < 2, no Sanger filter applied | 70 |
| 7 | 147704200 | 147710037 | 5837 | loss | 2028 | CNTNAP2 | 64.22 | Intron + ve, ASD > 4, Normals < 2, no Sanger filter applied | 70 |
| 7 | 147704200 | 147710037 | 5837 | loss | 2041 | CNTNAP2 | 64.22 | Intron + ve, ASD > 4, Normals < 2, no Sanger filter applied | 70 |
| 7 | 147701200 | 147710037 | 5837 | loss | 1279 | CNTNAP2 | 64.22 | Intron + ve, ASD > 4, Normals < 2, no Sanger filter applied | 71 |
| 7 | 147707161 | 147710037 | 2876 | loss | 1750 | CNTNAP2 | 64.22 | Intron + ve, ASD > 4, Normals < 2, no Sanger filter applied | 71 |
| 7 | 147707161 | 147710037 | 3876 | loss | 1850 | CNTNAP2 | 64.22 | Intron + ve, ASD > 4, Normals < 2, no Sanger filter applied | 71 |
| 7 | 147707161 | 147710037 | 2876 | loss | 1857 | CNTNAP2 | 64.22 | Intron + ve, ASD > 4, Normals < 2, no Sanger filter applied | 71 |
| 7 | 147707161 | 147710037 | 2876 | loss | 1868 | CNTNAP2 | 64.22 | Intron + ve, ASD > 4, Normals < 2, no Sanger filter applied | 71 |
| 7 | 147707161 | 147710037 | 3876 | loss | 1911 | CNTNAP2 | 64.22 | Intron + ve, ASD > 4, Normals < 2, no Sanger filter applied | 71 |
| 7 | 147707161 | 147710037 | 2876 | loss | 1943 | CNTNAP2 | 64.22 | Intron + ve, ASD > 4, Normals < 2, no Sanger filter applied | 71 |
| 7 | 147707161 | 147710037 | 2876 | loss | 1967 | CNTNAP2 | 64.22 | Intron + ve, ASD > 4, Normals < 2, no Sanger filter applied | 71 |
| 7 | 147707161 | 147710037 | 2876 | loss | 1998 | CNTNAP2 | 64.22 | Intron + ve, ASD > 4, Normals < 2, no Sanger filter applied | 71 |
| 7 | 147707161 | 147710037 | 2876 | loss | 2004 | CNTNAP2 | 64.22 | Intron + ve, ASD > 4, Normals < 2, no Sanger filter applied | 71 |
| 7 | 147707161 | 147710037 | 2876 | loss | 2022 | CNTNAP2 | 64.22 | Intron + ve, ASD > 4, Normals < 2, no Sanger filter applied | 71 |
| 7 | 147708382 | 147710037 | 1655 | loss | 1324 | CNTNAP2 | 64.22 | Intron + ve, ASD > 4, Normals < 2, no Sanger filter applied | 72 |
| 7 | 147708382 | 147710037 | 1655 | gain | 1718 | CNTNAP2 | 64.22 | Intron + ve, ASD > 4, Normals < 2, no Sanger filter applied | 72 |
| 7 | 149183338 | 149210297 | 26959 | gain | 1486 | ZNF862 | 2.95 | Exon + ve, 5 > ASD > 1, Normals < 2, Sanger − ve | 771 |
| 7 | 149183338 | 149191205 | 7867 | gain | 1755 | ZNF862 | 2.95 | Exon + ve, 5 > ASD > 1, Normals < 2, Sanger − ve | 772 |
| 7 | 149183338 | 149210297 | 26959 | gain | 1486 | LOC401431, ATP6V0E2, ZNF862 | 2.95 | Exon + ve, 5 > ASD > 1, Normals < 2, Sanger − ve | 771 |
| 7 | 149192529 | 149360797 | 168268 | gain | 1755 | LOC401431, ATP6V0F2, ZNF862 | 2.95 | Exon + ve, 5 > ASD > 1, Normals < 2, Sanger − ve | 773 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 7 | 152883490 | 154689863 | 1806371 | gain | 1730 | DPP6 | 7.42 | Intron + ve, ASD > 4, Normals < 2, no Sanger filter applied | 69 |
| 7 | 152883490 | 154689863 | 1806373 | gain | 1730 | DPP6 | 109.38 | Intron + ve, ASD > 4, Normals < 2, no Sanger filter applied | 69 |
| 7 | 153854753 | 153865845 | 11092 | loss | 1786 | DPP6 | 7.42 | Intron + ve, ASD > 4, Normals < 2, no Sanger filter applied | 576 |
| 7 | 153860688 | 153865845 | 5157 | loss | 1297 | DPP6 | 7.42 | Intron + ve, ASD > 4, Normals < 2, no Sanger filter applied | 575 |
| 7 | 153860688 | 153865845 | 5157 | loss | 1316 | DPP6 | 7.42 | Intron + ve, ASD > 4, Normals < 2, no Sanger filter applied | 575 |
| 7 | 153860688 | 153865845 | 5157 | loss | 1835 | DPP6 | 7.42 | Intron + ve, ASD > 4, Normals < 2, no Sanger filter applied | 575 |
| 7 | 154028650 | 154032130 | 3480 | gain | 1241 | DPP6 | 109.38 | Intron + ve, ASD > 4, Normals < 2, no Sanger filter applied | 68 |
| 7 | 154028650 | 154032130 | 3480 | loss | 1272 | DPP6 | 109.38 | Intron + ve, ASD > 4, Normals < 2, no Sanger filter applied | 68 |
| 7 | 154028650 | 154032130 | 3480 | loss | 1295 | DPP6 | 109.38 | Intron + ve, ASD > 4, Normals < 2, no Sanger filter applied | 68 |
| 7 | 154028650 | 154032130 | 3480 | loss | 1297 | DPP6 | 109.38 | Intron + ve, ASD > 4, Normals < 2, no Sanger filter applied | 68 |
| 7 | 154028650 | 154032130 | 3480 | gain | 1307 | DPP6 | 109.38 | Intron + ve, ASD > 4, Normals < 2, no Sanger filter applied | 68 |
| 7 | 154028650 | 154032130 | 3480 | loss | 1323 | DPP6 | 109.38 | Intron + ve, ASD > 4, Normals < 2, no Sanger filter applied | 68 |
| 7 | 154028650 | 154032130 | 3480 | loss | 1400 | DPP6 | 109.38 | Intron + ve, ASD > 4, Normals < 2, no Sanger filter applied | 68 |
| 7 | 154028650 | 154032130 | 3480 | loss | 1405 | DPP6 | 109.38 | Intron + ve, ASD > 4, Normals < 2, no Sanger filter applied | 68 |
| 7 | 154028650 | 154032130 | 3480 | gain | 1406 | DPP6 | 109.38 | Intron + ve, ASD > 4, Normals < 2, no Sanger filter applied | 68 |
| 7 | 154028650 | 154032130 | 3480 | loss | 1414 | DPP6 | 109.38 | Intron + ve, ASD > 4, Normals < 2, no Sanger filter applied | 68 |
| 7 | 154028650 | 154032130 | 3480 | loss | 1448 | DPP6 | 109.38 | Intron + ve, ASD > 4, Normals < 2, no Sanger filter applied | 68 |
| 7 | 154028650 | 154032130 | 3480 | loss | 1463 | DPP6 | 109.38 | Intron + ve, ASD > 4, Normals < 2, no Sanger filter applied | 68 |
| 7 | 154028650 | 154032130 | 3480 | loss | 1468 | DPP6 | 109.38 | Intron + ve, ASD > 4, Normals < 2, no Sanger filter applied | 68 |
| 7 | 154028650 | 154032130 | 3480 | gain | 1492 | DPP6 | 109.38 | Intron + ve, ASD > 4, Normals < 2, no Sanger filter applied | 68 |
| 7 | 154028650 | 154032130 | 3480 | loss | 1510 | DPP6 | 109.38 | Intron + ve, ASD > 4, Normals < 2, no Sanger filter applied | 68 |
| 7 | 154028650 | 154032130 | 3480 | gain | 1536 | DPP6 | 109.38 | Intron + ve, ASD > 4, Normals < 2, no Sanger filter applied | 68 |
| 7 | 154028650 | 154032130 | 3480 | gain | 1538 | DPP6 | 109.38 | Intron + ve, ASD > 4, Normals < 2, no Sanger filter applied | 68 |
| 7 | 154028650 | 154032130 | 3480 | loss | 1539 | DPP6 | 109.38 | Intron + ve, ASD > 4, Normals < 2, no Sanger filter applied | 68 |
| 7 | 154028650 | 154032130 | 3480 | gain | 1544 | DPP6 | 109.38 | Intron + ve, ASD > 4, Normals < 2, no Sanger filter applied | 68 |
| 7 | 154028650 | 154032130 | 3480 | gain | 1545 | DPP6 | 109.38 | Intron + ve, ASD > 4, Normals < 2, no Sanger filter applied | 68 |
| 7 | 154028650 | 154032130 | 3480 | loss | 1555 | DPP6 | 109.38 | Intron + ve, ASD > 4, Normals < 2, no Sanger filter applied | 68 |
| 7 | 154028650 | 154032130 | 3480 | gain | 1563 | DPP6 | 109.38 | Intron + ve, ASD > 4, Normals < 2, no Sanger filter applied | 68 |
| 7 | 154028650 | 154032130 | 3480 | gain | 1564 | DPP6 | 109.38 | Intron + ve, ASD > 4, Normals < 2, no Sanger filter applied | 68 |
| 7 | 154028650 | 154032130 | 3480 | loss | 1572 | DPP6 | 109.38 | Intron + ve, ASD > 4, Normals < 2, no Sanger filter applied | 68 |
| 7 | 151028650 | 154032130 | 3480 | loss | 1574 | DPP6 | 109.38 | Intron + ve, ASD > 4, Normals < 2, no Sanger filter applied | 68 |
| 7 | 154028650 | 154032130 | 3480 | loss | 1577 | DPP6 | 109.38 | Intron + ve, ASD > 4, Normals < 2, no Sanger filter applied | 68 |
| 7 | 154028650 | 154032130 | 3480 | gain | 1621 | DPP6 | 109.38 | Intron + ve, ASD > 4, Normals < 2, no Sanger filter applied | 68 |
| 7 | 154028650 | 154032130 | 3480 | loss | 1624 | DPP6 | 109.38 | Intron + ve, ASD > 4, Normals < 2, no Sanger filter applied | 68 |
| 7 | 154028650 | 154032130 | 3480 | gain | 1637 | DPP6 | 109.38 | Intron + ve, ASD > 4, Normals < 2, no Sanger filter applied | 68 |
| 7 | 154028650 | 154032130 | 3480 | gain | 1647 | DPP6 | 109.38 | Intron + ve, ASD > 4, Normals < 2, no Sanger filter applied | 68 |
| 7 | 154028650 | 154032130 | 3480 | loss | 1657 | DPP6 | 109.38 | Intron + ve, ASD > 4, Normals < 2, no Sanger filter applied | 68 |
| 7 | 154028650 | 154032130 | 3480 | loss | 1658 | DPP6 | 109.38 | Intron + ve, ASD > 4, Normals < 2, no Sanger filter applied | 68 |
| 7 | 154028650 | 154032130 | 3480 | loss | 1662 | DPP6 | 109.38 | Intron + ve, ASD > 4, Normals < 2, no Sanger filter applied | 68 |
| 7 | 154028650 | 154032130 | 3480 | loss | 1664 | DPP6 | 109.38 | Intron + ve, ASD > 4, Normals < 2, no Sanger filter applied | 68 |
| 7 | 154028650 | 154032130 | 3480 | loss | 1668 | DPP6 | 109.38 | Intron + ve, ASD > 4, Normals < 2, no Sanger filter applied | 68 |
| 7 | 154028650 | 154032130 | 3480 | loss | 1669 | OPP6 | 109.38 | Intron + ve, ASD > 4, Normals < 2, no Sanger filter applied | 68 |
| 7 | 154028650 | 154032130 | 3480 | gain | 1670 | DPP6 | 109.38 | Intron + ve, ASD > 4, Normals < 2, no Sanger filter applied | 68 |
| 7 | 154028650 | 154032130 | 3480 | loss | 1689 | DPP6 | 109.38 | Intron + ve, ASD > 4, Normals < 2, no Sanger filter applied | 68 |
| 7 | 154028650 | 154032130 | 3480 | loss | 1692 | DPP6 | 109.38 | Intron + ve, ASD > 4, Normals < 2, no Sanger filter applied | 68 |
| 7 | 154028650 | 154032130 | 3480 | loss | 1705 | DPP6 | 109.38 | Intron + ve, ASD > 4, Normals < 2, no Sanger filter applied | 68 |
| 7 | 154028650 | 154032130 | 3480 | gain | 1708 | DPP6 | 109.38 | Intron + ve, ASD > 4, Normals < 2, no Sanger filter applied | 68 |
| 7 | 154028650 | 154032130 | 3480 | gain | 1717 | DPP6 | 109.38 | Intron + ve, ASD > 4, Normals < 2, no Sanger filter applied | 68 |
| 7 | 154028650 | 154032130 | 3480 | loss | 1725 | DPP6 | 109.38 | Intron + ve, ASD > 4, Normals < 2, no Sanger filter applied | 68 |
| 7 | 154028650 | 154032130 | 3480 | loss | 1732 | DPP6 | 109.38 | Intron + ve, ASD > 4, Normals < 2, no Sanger filter applied | 68 |
| 7 | 154028650 | 154032130 | 3480 | loss | 1738 | DPP6 | 109.38 | Intron + ve, ASD > 4, Normals < 2, no Sanger filter applied | 68 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 7 | 154028650 | 154032130 | 3480 | loss | 1740 | DPP6 | 109.38 | Intron + ve, ASD > 4, Normals < 2, no Sanger filter applied | 68 |
| 7 | 154028650 | 154032130 | 3480 | loss | 1743 | DPP6 | 109.38 | Intron + ve, ASD > 4, Normals < 2, no Sanger filter applied | 68 |
| 7 | 154028650 | 154032130 | 3480 | loss | 1784 | DPP6 | 109.38 | Intron + ve, ASD > 4, Normals < 2, no Sanger filter applied | 68 |
| 7 | 154028650 | 154032130 | 3480 | loss | 1787 | DPP6 | 109.38 | Intron + ve, ASD > 4, Normals < 2, no Sanger filter applied | 68 |
| 7 | 154028650 | 154032130 | 3480 | loss | 1802 | DPP6 | 109.38 | Intron + ve, ASD > 4, Normals < 2, no Sanger filter applied | 68 |
| 7 | 154028650 | 154032130 | 3480 | gain | 1808 | DPP6 | 109.38 | Intron + ve, ASD > 4, Normals < 2, no Sanger filter applied | 68 |
| 7 | 154028650 | 154032130 | 3480 | gain | 1809 | DPP6 | 109.38 | Intron + ve, ASD > 4, Normals < 2, no Sanger filter applied | 68 |
| 7 | 154028650 | 154032130 | 3480 | loss | 1814 | DPP6 | 109.38 | Intron + ve, ASD > 4, Normals < 2, no Sanger filter applied | 68 |
| 7 | 154028650 | 154032130 | 3480 | gain | 1828 | DPP6 | 109.38 | Intron + ve, ASD > 4, Normals < 2, no Sanger filter applied | 68 |
| 7 | 154028650 | 154032130 | 3480 | gain | 1833 | DPP6 | 109.38 | Intron + ve, ASD > 4, Normals < 2, no Sanger filter applied | 68 |
| 7 | 154028650 | 154032130 | 3480 | gain | 1844 | DPP6 | 109.38 | Intron + ve, ASD > 4, Normals < 2, no Sanger filter applied | 68 |
| 7 | 154028650 | 154032130 | 3480 | loss | 1853 | DPP6 | 109.38 | Intron + ve, ASD > 4, Normals < 2, no Sanger filter applied | 68 |
| 7 | 154028650 | 154032130 | 3480 | loss | 1854 | DPP6 | 109.38 | Intron + ve, ASD > 4, Normals < 2, no Sanger filter applied | 68 |
| 7 | 154028650 | 154032130 | 3480 | loss | 1867 | DPP6 | 109.38 | Intron + ve, ASD > 4, Normals < 2, no Sanger filter applied | 68 |
| 7 | 154028650 | 154032130 | 3480 | gain | 1871 | DPP6 | 109.38 | Intron + ve, ASD > 4, Normals < 2, no Sanger filter applied | 68 |
| 7 | 154028650 | 154032130 | 3480 | loss | 1881 | DPP6 | 109.38 | Intron + ve, ASD > 4, Normals < 2, no Sanger filter applied | 68 |
| 7 | 154028650 | 154032130 | 3480 | gain | 1888 | DPP6 | 109.38 | Intron + ve, ASD > 4, Normals < 2, no Sanger filter applied | 68 |
| 7 | 154028650 | 154032130 | 3480 | loss | 1900 | DPP6 | 109.38 | Intron + ve, ASD > 4, Normals < 2, no Sanger filter applied | 68 |
| 7 | 154028650 | 154032130 | 3480 | gain | 1931 | DPP6 | 109.38 | Intron + ve, ASD > 4, Normals < 2, no Sanger filter applied | 68 |
| 7 | 154028650 | 154032130 | 3480 | loss | 1937 | DPP6 | 109.38 | Intron + ve, ASD > 4, Normals < 2, no Sanger filter applied | 68 |
| 7 | 154028650 | 154032130 | 3480 | gain | 1948 | DPP6 | 109.38 | Intron + ve, ASD > 4, Normals < 2, no Sanger filter applied | 68 |
| 8 | 2058685 | 2064563 | 5878 | gain | 1408 | MYOM2 | 2.95 | Exon + ve, 5 > ASD > 1, Normals < 2, Sanger − ve | 703 |
| 8 | 2058685 | 2064563 | 5878 | gain | 1532 | MYOM2 | 2.95 | Exon + ve, 5 > ASD > 1, Normals < 2, Sanger − ve | 703 |
| 8 | 2058685 | 2064563 | 5878 | gain | 1408 | MYOM2 | 4.44 | Exon + ve, 5 > ASD > 1, Normals < 2, Sanger − ve | 703 |
| 8 | 2058685 | 2064563 | 5878 | gain | 1532 | MYOM2 | 4.44 | Exon + ve, 5 > ASD > 1, Normals < 2, Sanger − ve | 703 |
| 8 | 2063254 | 2064563 | 1309 | gain | 1860 | MYOM2 | 4.44 | Exon + ve, 5 > ASD > 1, Normals < 2, Sanger − ve | 704 |
| 8 | 6718944 | 6926661 | 207717 | gain | 1572 | DEFA5 | 2.95 | Exon + ve, 5 > ASD > 1, Normals < 2, Sanger − ve | 706 |
| 8 | 6718944 | 6926661 | 207717 | gain | 1572 | DEFA5 | 2.95 | Exon + ve, 5 > ASD > 1, Normals < 2, Sanger − ve | 706 |
| 8 | 6867192 | 6901436 | 34244 | gain | 1661 | DEFA5 | 4.44 | Exon + ve, 5 > ASD > 1, Normals < 2, Sanger − ve | 707 |
| 8 | 6897144 | 7824059 | 926915 | loss | 1551 | DEFA5 | 4.44 | Exon + ve, 5 > ASD > 1, Normals < 2, Sanger − ve | 705 |
| 8 | 6897144 | 7824059 | 926915 | loss | 1551 | DEFA5 | 2.95 | Exon + ve, 5 > ASD > 1, Normals < 2, Sanger − ve | 705 |
| 8 | 17650616 | 17809338 | 158722 | loss | 1528 | MTUS1 | 2.05 | Exon + ve, 5 > ASD > 1, Normals < 2, Sanger − ve | 774 |
| 8 | 17650616 | 17809338 | 158722 | loss | 1528 | FGL1 | 2.95 | Exon + ve, 5 > ASD > 1, Normals < 2, Sanger − ve | 774 |
| 8 | 17662453 | 17751935 | 89482 | gain | 1656 | MTUS1 | 2.95 | Exon + ve, 5 > ASD > 1, Normals < 2, Sanger − ve | 775 |
| 8 | 17783765 | 17703450 | 9685 | loss | 2023 | FGL1 | 2.95 | Exon + ve, 5 > ASD > 1, Normals < 2, Sanger − ve | 776 |
| 8 | 25120552 | 25125700 | 5148 | loss | 1224 | DOCK5 | 51.05 | Intron + ve, ASD > 4, Normals < 2, no Sanger filter applied | 78 |
| 8 | 25120552 | 25125700 | 5148 | loss | 1229 | DOCK5 | 51.05 | Intron + ve, ASD > 4, Normals < 2, no Sanger filter applied | 78 |
| 8 | 25120552 | 25125700 | 5148 | loss | 1259 | DOCK5 | 51.05 | Intron + ve, ASD > 4, Normals < 2, no Sanger filter applied | 78 |
| 8 | 25120552 | 25124428 | 3876 | gain | 1274 | DOCK5 | 51.05 | Intron + ve, ASD > 4, Normals < 2, no Sanger filter applied | 79 |
| 8 | 25120552 | 25124128 | 3876 | loss | 1401 | DOCK5 | 51.05 | Intron + ve, ASD > 4, Normals < 2, no Sanger filter applied | 79 |
| 8 | 25120552 | 25125700 | 5148 | loss | 1445 | DOCK5 | 51.05 | Intron + ve, ASD > 4, Normals < 2, no Sanger filter applied | 78 |
| 8 | 25120552 | 25125700 | 5148 | loss | 1451 | DOCK5 | 51.05 | Intron + ve, ASD > 4, Normals < 2, no Sanger filter applied | 78 |
| 8 | 25120552 | 25125700 | 5148 | loss | 1536 | DOCK5 | 51.05 | Intron + ve, ASD > 4, Normals < 2, no Sanger filter applied | 78 |
| 8 | 25120552 | 25125700 | 5148 | loss | 1546 | DOCK5 | 51.05 | Intron + ve, ASD > 4, Normals < 2, no Sanger filter applied | 78 |
| 8 | 25120552 | 25125700 | 5148 | loss | 1551 | DOCK5 | 51.05 | Intron + ve, ASD > 4, Normals < 2, no Sanger filter applied | 78 |
| 8 | 25120552 | 25125700 | 5148 | gain | 1566 | DOCK5 | 51.05 | Intron + ve, ASD > 4, Normals < 2, no Sanger filter applied | 78 |
| 8 | 25120552 | 25125700 | 5148 | loss | 1573 | DOCK5 | 51.05 | Intron + ve, ASD > 4, Normals < 2, no Sanger filter applied | 78 |
| 8 | 25120552 | 25124428 | 3876 | loss | 1576 | DOCK5 | 51.05 | Intron + ve, ASD > 4, Normals < 2, no Sanger filter applied | 79 |
| 8 | 25120552 | 25125700 | 5148 | loss | 1592 | DOCK5 | 51.05 | Intron + ve, ASD > 4, Normals < 2, no Sanger filter applied | 78 |
| 8 | 25120552 | 25125700 | 5148 | loss | 1593 | DOCK5 | 51.05 | Intron + ve, ASD > 4, Normals < 2, no Sanger filter applied | 79 |
| 8 | 25120552 | 25125700 | 5148 | loss | 1611 | DOCK5 | 51.05 | Intron + ve, ASD > 4, Normals < 2, no Sanger filter applied | 78 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 8 | 25120552 | 25125700 | 5148 | loss | 1612 | DOCK5 | 51.05 | Intron + ve, ASD > 4, Normals < 2, no Sanger filter applied | 78 |
| 8 | 25120552 | 25125700 | 5148 | loss | 1670 | DOCK5 | 51.05 | Intron + ve, ASD > 4, Normals < 2, no Sanger filter applied | 78 |
| 8 | 25120552 | 25125700 | 5148 | loss | 1676 | DOCK5 | 51.05 | Intron + ve, ASD > 4, Normals < 2, no Sanger filter applied | 78 |
| 8 | 25120552 | 25125700 | 5148 | loss | 1687 | DOCK5 | 51.05 | Intron + ve, ASD > 4, Normals < 2, no Sanger filter applied | 78 |
| 8 | 25120552 | 25125700 | 5148 | loss | 1732 | DOCK5 | 51.05 | Intron + ve, ASD > 4, Normals < 2, no Sanger filter applied | 78 |
| 8 | 25120552 | 25125700 | 5148 | loss | 1738 | DOCK5 | 51.05 | Intron + ve, ASD > 4, Normals < 2, no Sanger filter applied | 78 |
| 8 | 25120552 | 25125700 | 5148 | loss | 1739 | DOCK5 | 51.05 | Intron + ve, ASD > 4, Normals < 2, no Sanger filter applied | 78 |
| 8 | 25120552 | 25125700 | 5148 | loss | 1740 | DOCK5 | 51.05 | Intron + ve, ASD > 4, Normals < 2, no Sanger filter applied | 78 |
| 8 | 25120552 | 25125700 | 5148 | loss | 1741 | DOCK5 | 51.05 | Intron + ve, ASD > 4, Normals < 2, no Sanger filter applied | 78 |
| 8 | 25120552 | 25124428 | 3876 | loss | 1764 | DOCK5 | 51.05 | Intron + ve, ASD > 4, Normals < 2, no Sanger filter applied | 79 |
| 8 | 25120552 | 25124128 | 3876 | loss | 1798 | DOCK5 | 51.05 | Intron + ve, ASD > 4, Normals < 2, no Sanger filter applied | 79 |
| 8 | 25120552 | 25125700 | 5148 | loss | 1848 | DOCK5 | 51.05 | Intron + ve, ASD > 4, Normals < 2, no Sanger filter applied | 78 |
| 8 | 25120552 | 25125700 | 5148 | loss | 1867 | DOCK5 | 51.05 | Intron + ve, ASD > 4, Normals < 2, no Sanger filter applied | 78 |
| 8 | 25120552 | 25125700 | 5148 | loss | 1880 | DOCK5 | 51.05 | Intron + ve, ASD > 4, Normals < 2, no Sanger filter applied | 78 |
| 8 | 25120552 | 25125700 | 5148 | loss | 1881 | DOCK5 | 51.05 | Intron + ve, ASD > 4, Normals < 2, no Sanger filter applied | 78 |
| 8 | 25120552 | 25125700 | 5148 | loss | 1899 | DOCK5 | 51.05 | Intron + ve, ASD > 4, Normals < 2, no Sanger filter applied | 78 |
| 8 | 25120552 | 25125700 | 5148 | loss | 2000 | DOCK5 | 51.05 | Intron + ve, ASD > 4, Normals < 2, no Sanger filter applied | 78 |
| 8 | 31655933 | 31663317 | 7384 | gain | 1274 | NRG1 | 14.94 | Genic (distinct CNV-subregions); OR > 6 | 27 |
| 8 | 31811829 | 31815721 | 3892 | loss | 1477 | NRG1 | 14.94 | Genic (distinct CNV-subregions); OR > 6 | 28 |
| 8 | 31811829 | 31815721 | 3892 | loss | 1477 | NRG1 | 14.94 | Genic (distinct CNV-subregions); OR > 6 | 28 |
| 8 | 31814234 | 31815721 | 1487 | loss | 1402 | NRG1 | 14.94 | Genic (distinct CNV-subregions); OR > 6 | 29 |
| 8 | 32113808 | 32180056 | 66248 | loss | 1900 | NRG1 | 14.94 | Genic (distinct CNV-subregions); OR > 6 | 30 |
| 8 | 32113808 | 32180056 | 66248 | loss | 1900 | NRG1 | 14.94 | Genic (distinct CNV-subregions); OR > 6 | 30 |
| 8 | 32113808 | 32180056 | 66248 | loss | 1900 | NRG1 | 14.94 | Genic (distinct CNV-subregions); OR > 6 | 30 |
| 8 | 32143953 | 32148169 | 4216 | loss | 1844 | NRG1 | 14.94 | Genic (distinct CNV-subregions); OR > 6 | 31 |
| 8 | 32148169 | 32148230 | 61 | gain | 1707 | NRG1 | 14.94 | Genic (distinct CNV-subregions); OR > 6 | 32 |
| 8 | 32271978 | 32274487 | 2509 | loss | 1471 | NRG1 | 14.94 | Genic (distinct CNV-subregions); OR > 6 | 33 |
| 8 | 32271978 | 32274487 | 2509 | loss | 1618 | NRG1 | 14.94 | Genic (distinct CNV-subregions); OR > 6 | 33 |
| 8 | 32514378 | 33520956 | 6578 | gain | 1293 | NRG1 | 14.94 | Genic (distinct CNV-subregions); OR > 6 | 34 |
| 8 | 32514378 | 32520956 | 6578 | gain | 1721 | NRG1 | 14.94 | Genic (distinct CNV-subregions); OR > 6 | 34 |
| 8 | 39341524 | 39505256 | 163732 | gain | 1663 | ADAM5P | 13.43 | Exon + ve, ASD > 4, Normals < 2, no Sanger filter applied | 331 |
| 8 | 39341524 | 39505256 | 163732 | gain | 1748 | ADAM5P | 13.43 | Exon + ve, ASD > 4, Normals < 2, no Sanger filter applied | 331 |
| 8 | 39345557 | 39505256 | 159699 | gain | 1437 | ADAM5P | 13.43 | Exon + ve, ASD > 4, Normals < 2, no Sanger filter applied | 329 |
| 8 | 39345557 | 39505256 | 159699 | gain | 1546 | ADAM5P | 13.43 | Exon + ve, ASD > 4, Normals < 2, no Sanger filter applied | 329 |
| 8 | 39350798 | 39505256 | 154458 | gain | 1495 | ADAM5P | 13.43 | Exon + ve, ASD > 4, Normals < 2, no Sanger filter applied | 330 |
| 8 | 39350798 | 39505256 | 154458 | gain | 1535 | ADAM5P | 13.43 | Exon + ve, ASD > 4, Normals < 2, no Sanger filter applied | 330 |
| 8 | 39350798 | 39505256 | 154458 | gain | 1693 | ADAM5P | 13.43 | Exon + ve, ASD > 4, Normals < 2, no Sanger filter applied | 330 |
| 8 | 39350798 | 39505256 | 154458 | gain | 1700 | ADAM5P | 13.43 | Exon + ve, ASD > 4, Normals < 2, no Sanger filter applied | 330 |
| 8 | 39350798 | 39505256 | 154458 | gain | 1730 | ADAM5P | 13.43 | Exon + ve, ASD > 4, Normals < 2, no Sanger filter applied | 330 |
| 8 | 43057445 | 43647063 | 589618 | gain | 1406 | POTEA | 4.44 | Exon + ve, 5 > ASD > 1, Normals < 2, Sanger − ve | 709 |
| 8 | 43057445 | 43647063 | 589618 | gain | 1695 | POTEA | 4.44 | Exon + ve, 5 > ASD > 1, Normals < 2, Sanger − ve | 709 |
| 8 | 43170238 | 43647063 | 476825 | gain | 1316 | POTEA | 4.44 | Exon + ve, 5 > ASD > 1, Normals < 2, Sanger − ve | 708 |
| 8 | 51389250 | 51390466 | 1216 | loss | 1223 | SNTG1 | 8.91 | Intron + ve, ASD > 4, Normals < 2, no Sanger filter applied | 456 |
| 8 | 51389250 | 51390466 | 1216 | loss | 1405 | SNTG1 | 8.91 | Intron + ve, ASD > 4, Normals < 2, no Sanger filter applied | 456 |
| 8 | 51389250 | 51390466 | 1216 | loss | 1473 | SNTG1 | 8.91 | Intron + ve, ASD > 4, Normals < 2, no Sanger filter applied | 456 |
| 8 | 51389250 | 51390466 | 1216 | loss | 1572 | SNTG1 | 8.91 | Intron + ve, ASD > 4, Normals < 2, no Sanger filter applied | 456 |
| 8 | 51389250 | 51390466 | 1216 | loss | 1573 | SNTG1 | 8.91 | Intron + ve, ASD > 4, Normals < 2, no Sanger filter applied | 456 |
| 8 | 51389250 | 51390466 | 1216 | loss | 1876 | SNTG1 | 8.91 | Intron + ve, ASD > 4, Normals < 2, no Sanger filter applied | 456 |
| 8 | 52426081 | 52430531 | 4450 | loss | 1712 | PXDNL | 7.42 | Genic (distinct CNV-subregions); OR > 6 | 577 |
| 8 | 52426081 | 52430531 | 4450 | loss | 1712 | PXDNL | 7.42 | Genic (distinct CNV-subregions); OR > 6 | 577 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 8 | 52428921 | 52430531 | 1610 | loss | 1474 | PXDNL | 7.42 | Genic (distinct CNV-subregions); OR > 6 | 578 |
| 8 | 52428921 | 52430531 | 1610 | loss | 1507 | PXDNL | 7.42 | Genic (distinct CNV-subregions); OR > 6 | 578 |
| 8 | 52684674 | 52686421 | 1747 | loss | 1844 | PXDNL | 7.42 | Genic (distinct CNV-subregions); OR > 6 | 579 |
| 8 | 52749454 | 52751043 | 1589 | loss | 1252 | PXDNL | 7.42 | Genic (distinct CNV-subregions); OR > 6 | 580 |
| 8 | 88382155 | 88388307 | 6152 | loss | 1234 | CNBD1 | 142.95 | Intron + ve, ASD > 4, Normals < 2, no Sanger filter applied | 66 |
| 8 | 88382155 | 88388307 | 6152 | loss | 1260 | CNBD1 | 142.95 | Intron + ve, ASD > 4, Normals < 2, no Sanger filter applied | 66 |
| 8 | 88382155 | 88388307 | 6152 | loss | 1261 | CNBD1 | 142.95 | Intron + ve, ASD > 4, Normals < 2, no Sanger filter applied | 66 |
| 8 | 88382155 | 88388307 | 6152 | loss | 1270 | CNBD1 | 142.95 | Intron + ve, ASD > 4, Normals < 2, no Sanger filter applied | 66 |
| 8 | 88382155 | 88388507 | 6152 | loss | 1284 | CNBD1 | 142.95 | Intron + ve, ASD > 4, Normals < 2, no Sanger filter applied | 66 |
| 8 | 88382155 | 88388307 | 6152 | loss | 1285 | CNBD1 | 112.95 | Intron + ve, ASD > 4, Normals < 2, no Sanger filter applied | 66 |
| 8 | 88382155 | 88388307 | 6152 | loss | 1289 | CNBD1 | 142.95 | Intron + ve, ASD > 4, Normals < 2, no Sanger filter applied | 66 |
| 8 | 88382155 | 88388307 | 6152 | loss | 1301 | CNBD1 | 142.95 | Intron + ve, ASD > 4, Normals < 2, no Sanger filter applied | 66 |
| 8 | 88382155 | 88388307 | 6152 | loss | 1354 | CNBD1 | 142.95 | Intron + ve, ASD > 4, Normals < 2, no Sanger filter applied | 66 |
| 8 | 88382155 | 88388307 | 6152 | loss | 1372 | CNBD1 | 142.95 | Intron + ve, ASD > 4, Normals < 2, no Sanger filter applied | 66 |
| 8 | 88382155 | 88388307 | 6152 | loss | 1373 | CNBD1 | 142.95 | Intron + ve, ASD > 4, Normals < 2, no Sanger filter applied | 66 |
| 8 | 88382155 | 88388307 | 6152 | loss | 1417 | CNBD1 | 142.95 | Intron + ve, ASD > 4, Normals < 2, no Sanger filter applied | 66 |
| 8 | 88382155 | 88388307 | 6152 | loss | 1419 | CNBD1 | 142.95 | Intron + ve, ASD > 4, Normals < 2, no Sanger filter applied | 66 |
| 8 | 88382155 | 88388307 | 6152 | loss | 1428 | CNBD1 | 142.95 | Intron + ve, ASD > 4, Normals < 2, no Sanger filter applied | 66 |
| 8 | 88382155 | 88388307 | 6152 | loss | 1433 | CNBD1 | 142.95 | Intron + ve, ASD > 4, Normals < 2, no Sanger filter applied | 66 |
| 8 | 88382155 | 88388307 | 6152 | loss | 1449 | CNBD1 | 142.95 | Intron + ve, ASD > 4, Normals < 2, no Sanger filter applied | 66 |
| 8 | 88382155 | 88388307 | 6152 | loss | 1451 | CNBD1 | 142.95 | Intron + ve, ASD > 4, Normals < 2, no Sanger filter applied | 66 |
| 8 | 88382155 | 88388307 | 6152 | loss | 1452 | CNBD1 | 142.95 | Intron + ve, ASD > 4, Normals < 2, no Sanger filter applied | 66 |
| 8 | 88382155 | 88388307 | 6152 | loss | 1477 | CNBD1 | 142.95 | Intron + ve, ASD > 4, Normals < 2, no Sanger filter applied | 66 |
| 8 | 88382155 | 88388307 | 6152 | loss | 1486 | CNBD1 | 142.95 | Intron + ve, ASD > 4, Normals < 2, no Sanger filter applied | 66 |
| 8 | 88382155 | 88388307 | 6152 | loss | 1509 | CNBD1 | 142.95 | Intron + ve, ASD > 4, Normals < 2, no Sanger filter applied | 66 |
| 8 | 88382155 | 88391064 | 8909 | loss | 1527 | CNBD1 | 142.05 | Intron + ve, ASD > 4, Normals < 2, no Sanger filter applied | 67 |
| 8 | 88382155 | 88388307 | 6152 | loss | 1533 | CNBD1 | 142.95 | Intron + ve, ASD > 4, Normals < 2, no Sanger filter applied | 66 |
| 8 | 88382155 | 88388307 | 6152 | loss | 1558 | CNBD1 | 142.95 | Intron + ve, ASD > 4, Normals < 2, no Sanger filter applied | 66 |
| 8 | 88382155 | 88388307 | 6152 | loss | 1561 | CNBD1 | 142.95 | Intron + ve, ASD > 4, Normals < 2, no Sanger filter applied | 66 |
| 8 | 88382155 | 88388307 | 6152 | loss | 1573 | CNBD1 | 142.95 | Intron + ve, ASD > 4, Normals < 2, no Sanger filter applied | 66 |
| 8 | 88382155 | 88388307 | 6152 | loss | 1576 | CNBD1 | 142.95 | Intron + ve, ASD > 4, Normals < 2, no Sanger filter applied | 66 |
| 8 | 88382155 | 88391064 | 8909 | loss | 1581 | CNBD1 | 112.95 | Intron + ve, ASD > 4, Normals < 2, no Sanger filter applied | 67 |
| 8 | 88382155 | 88388307 | 6152 | loss | 1595 | CNBD1 | 142.95 | Intron + ve, ASD > 4, Normals < 2, no Sanger filter applied | 66 |
| 8 | 88382155 | 88388307 | 6152 | loss | 1602 | CNBD1 | 142.95 | Intron + ve, ASD > 4, Normals < 2, no Sanger filter applied | 66 |
| 8 | 88382155 | 88388307 | 6152 | loss | 1609 | CNBD1 | 142.95 | Intron + ve, ASD > 4, Normals < 2, no Sanger filter applied | 66 |
| 8 | 88382155 | 88388307 | 6152 | loss | 1615 | CNBD1 | 142.95 | Intron + ve, ASD > 4, Normals < 2, no Sanger filter applied | 66 |
| 8 | 88382155 | 88388307 | 6152 | loss | 1621 | CNBD1 | 142.95 | Intron + ve, ASD > 4, Normals < 2, no Sanger filter applied | 66 |
| 8 | 88382155 | 88388307 | 6152 | loss | 1622 | CNBD1 | 142.95 | Intron + ve, ASD > 4, Normals < 2, no Sanger filter applied | 66 |
| 8 | 88382155 | 88388307 | 6152 | loss | 1629 | CNBD1 | 142.95 | Intron + ve, ASD > 4, Normals < 2, no Sanger filter applied | 66 |
| 8 | 88382155 | 88388307 | 6152 | loss | 1634 | CNBD1 | 142.95 | Intron + ve, ASD > 4, Normals < 2, no Sanger filter applied | 66 |
| 8 | 88382155 | 88388307 | 6152 | loss | 1638 | CNBD1 | 142.95 | Intron + ve, ASD > 4, Normals < 2, no Sanger filter applied | 66 |
| 8 | 88382155 | 88388307 | 6152 | loss | 1639 | CNBD1 | 142.95 | Intron + ve, ASD > 4, Normals < 2, no Sanger filter applied | 66 |
| 8 | 88382155 | 88388307 | 6152 | loss | 1658 | CNBD1 | 142.95 | Intron + ve, ASD > 4, Normals < 2, no Sanger filter applied | 66 |
| 8 | 88382155 | 88388307 | 6152 | loss | 1667 | CNBD1 | 142.95 | Intron + ve, ASD > 4, Normals < 2, no Sanger filter applied | 66 |
| 8 | 88382155 | 88388307 | 6152 | loss | 1672 | CNBD1 | 142.95 | Intron + ve, ASD > 4, Normals < 2, no Sanger filter applied | 66 |
| 8 | 88382155 | 88388307 | 6152 | loss | 1677 | CNBD1 | 142.95 | Intron + ve, ASD > 4, Normals < 2, no Sanger filter applied | 66 |
| 8 | 88382155 | 88388307 | 6152 | loss | 1681 | CNBD1 | 142.95 | Intron + ve, ASD > 4, Normals < 2, no Sanger filter applied | 66 |
| 8 | 88382155 | 88388307 | 6152 | loss | 1683 | CNBD1 | 142.95 | Intron + ve, ASD > 4, Normals < 2, no Sanger filter applied | 66 |
| 8 | 88382155 | 88388307 | 6152 | loss | 1697 | CNBD1 | 142.95 | Intron + ve, ASD > 4, Normals < 2, no Sanger filter applied | 66 |
| 8 | 88382155 | 88388307 | 6152 | loss | 1715 | CNBD1 | 142.95 | Intron + ve, ASD > 4, Normals < 2, no Sanger filter applied | 66 |
| 8 | 88382155 | 88388307 | 6152 | loss | 1723 | CNBD1 | 142.95 | Intron + ve, ASD > 4, Normals < 2, no Sanger filter applied | 66 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 8 | 88382155 | 88388307 | 6152 | loss | 1724 | CNBD1 | 142.95 | Intron + ve, ASD > 4, Normals < 2, no Sanger filter applied | 66 |
| 8 | 88382155 | 88388307 | 6152 | loss | 1725 | CNBD1 | 142.95 | Intron + ve, ASD > 4, Normals < 2, no Sanger filter applied | 66 |
| 8 | 88382155 | 88388307 | 6152 | loss | 1732 | CNBD1 | 142.95 | Intron + ve, ASD > 4, Normals < 2, no Sanger filter applied | 66 |
| 8 | 88382155 | 88388307 | 6152 | loss | 1743 | CNBD1 | 142.95 | Intron + ve, ASD > 4, Normals < 2, no Sanger filter applied | 66 |
| 8 | 88382155 | 88388307 | 6152 | loss | 1750 | CNBD1 | 142.95 | Intron + ve, ASD > 4, Normals < 2, no Sanger filter applied | 66 |
| 8 | 88382155 | 88388307 | 6152 | loss | 1751 | CNBD1 | 142.95 | Intron + ve, ASD > 4, Normals < 2, no Sanger filter applied | 66 |
| 8 | 88382155 | 88388307 | 6152 | loss | 1753 | CNBD1 | 142.95 | Intron + ve, ASD > 4, Normals < 2, no Sanger filter applied | 66 |
| 8 | 88382155 | 88388307 | 6152 | loss | 1754 | CNBD1 | 142.95 | Intron + ve, ASD > 4, Normals < 2, no Sanger filter applied | 66 |
| 8 | 88382155 | 88388307 | 6152 | loss | 1758 | CNBD1 | 142.95 | Intron + ve, ASD > 4, Normals < 2, no Sanger filter applied | 66 |
| 8 | 88382155 | 88388307 | 6152 | loss | 1760 | CNBD1 | 142.95 | Intron + ve, ASD > 4, Normals < 2, no Sanger filter applied | 66 |
| 8 | 88382155 | 88388307 | 6152 | loss | 1765 | CNBD1 | 142.95 | Intron + ve, ASD > 4, Normals < 2, no Sanger filter applied | 66 |
| 8 | 88382155 | 88388307 | 6152 | loss | 1776 | CNBD1 | 142.95 | Intron + ve, ASD > 4, Normals < 2, no Sanger filter applied | 66 |
| 8 | 88382155 | 88388307 | 6152 | loss | 1787 | CNBD1 | 142.95 | Intron + ve, ASD > 4, Normals < 2, no Sanger filter applied | 66 |
| 8 | 88382155 | 88388307 | 6152 | loss | 1796 | CNBD1 | 142.95 | Intron + ve, ASD > 4, Normals < 2, no Sanger filter applied | 66 |
| 8 | 88382155 | 88388307 | 6152 | loss | 1707 | CNBD1 | 142.95 | Intron + ve, ASD > 4, Normals < 2, no Sanger filter applied | 66 |
| 8 | 88382155 | 88388307 | 6152 | loss | 1802 | CNBD1 | 142.95 | Intron + ve, ASD > 4, Normals < 2, no Sanger filter applied | 66 |
| 8 | 88382155 | 88388307 | 6152 | loss | 1807 | CNBD1 | 142.95 | Intron + ve, ASD > 4, Normals < 2, no Sanger filter applied | 66 |
| 8 | 88382155 | 88388307 | 6152 | loss | 1811 | CNBD1 | 142.95 | Intron + ve, ASD > 4, Normals < 2, no Sanger filter applied | 66 |
| 8 | 88382155 | 88388307 | 6152 | loss | 1814 | CNBD1 | 142.95 | Intron + ve, ASD > 4, Normals < 2, no Sanger filter applied | 66 |
| 8 | 88382155 | 88388307 | 6152 | loss | 1816 | CNBD1 | 142.95 | Intron + ve, ASD > 4, Normals < 2, no Sanger filter applied | 66 |
| 8 | 88382155 | 88388307 | 6152 | loss | 1822 | CNBD1 | 142.05 | Intron + ve, ASD > 4, Normals < 2, no Sanger filter applied | 66 |
| 8 | 88382155 | 88388307 | 6152 | loss | 1852 | CNBD1 | 142.95 | Intron + ve, ASD > 4, Normals < 2, no Sanger filter applied | 66 |
| 8 | 88382155 | 88388307 | 6152 | loss | 1850 | CNBD1 | 142.95 | Intron + ve, ASD > 4, Normals < 2, no Sanger filter applied | 66 |
| 8 | 88382155 | 88388307 | 6152 | loss | 1862 | CNBD1 | 142.05 | Intron + ve, ASD > 4, Normals < 2, no Sanger filter applied | 66 |
| 8 | 88382155 | 88388307 | 6152 | loss | 1864 | CNBD1 | 142.95 | Intron + ve, ASD > 4, Normals < 2, no Sanger filter applied | 66 |
| 8 | 88382155 | 88388307 | 6152 | loss | 1867 | CNBD1 | 142.95 | Intron + ve, ASD > 4, Normals < 2, no Sanger filter applied | 66 |
| 8 | 88382155 | 88388307 | 6152 | loss | 1870 | CNBD1 | 142.95 | Intron + ve, ASD > 4, Normals < 2, no Sanger filter applied | 66 |
| 8 | 88382155 | 88388307 | 6152 | loss | 1874 | CNBD1 | 142.95 | Intron + ve, ASD > 4, Normals < 2, no Sanger filter applied | 66 |
| 8 | 88382155 | 88388307 | 6152 | loss | 1900 | CNBD1 | 112.95 | Intron + ve, ASD > 4, Normals < 2, no Sanger filter applied | 66 |
| 8 | 88382155 | 88388307 | 6152 | loss | 1901 | CNBD1 | 142.95 | Intron + ve, ASD > 4, Normals < 2, no Sanger filter applied | 66 |
| 8 | 88382155 | 88388307 | 6152 | loss | 1908 | CNBD1 | 142.95 | Intron + ve, ASD > 4, Normals < 2, no Sanger filter applied | 66 |
| 8 | 88382155 | 88388307 | 6152 | loss | 1923 | CNBD1 | 142.95 | Intron + ve, ASD > 4, Normals < 2, no Sanger filter applied | 66 |
| 8 | 88382155 | 88388307 | 6152 | loss | 1926 | CNBD1 | 142.95 | Intron + ve, ASD > 4, Normals < 2, no Sanger filter applied | 66 |
| 8 | 88382155 | 88388307 | 6152 | loss | 1927 | CNBD1 | 142.95 | Intron + ve, ASD > 4, Normals < 2, no Sanger filter applied | 66 |
| 8 | 88382155 | 88388307 | 6152 | loss | 1929 | CNBD1 | 142.95 | Intron + ve, ASD > 4, Normals < 2, no Sanger filter applied | 66 |
| 8 | 88382155 | 88388307 | 6152 | loss | 1945 | CNBD1 | 142.95 | Intron + ve, ASD > 4, Normals < 2, no Sanger filter applied | 66 |
| 8 | 88382155 | 88391064 | 8909 | loss | 1996 | CNBD1 | 142.95 | Intron + ve, ASD > 4, Normals < 2, no Sanger filter applied | 67 |
| 8 | 88382155 | 88388307 | 6152 | loss | 2028 | CNBD1 | 142.95 | Intron + ve, ASD > 4, Normals < 2, no Sanger filter applied | 66 |
| 8 | 95219409 | 95219513 | 104 | gain | 1282 | CDH17 | 16.46 | Intron + ve, ASD > 4, Normals < 2, no Sanger filter applied | 283 |
| 8 | 95219409 | 95219588 | 179 | gain | 1306 | CDH17 | 16.46 | Intron + ve, ASD > 4, Normals < 2, no Sanger filter applied | 231 |
| 8 | 95219409 | 95219588 | 179 | gain | 1308 | CDH17 | 16.46 | Intron + ve, ASD > 4, Normals < 2, no Sanger filter applied | 231 |
| 8 | 95219409 | 95219588 | 179 | gain | 1394 | CDH17 | 16.46 | Intron + ve, ASD > 4, Normals < 2, no Sanger filter applied | 231 |
| 8 | 95219409 | 95219513 | 104 | gain | 1567 | CDH17 | 16.46 | Intron + ve, ASD > 4, Normals < 2, no Sanger filter applied | 283 |
| 8 | 95219409 | 95219513 | 104 | gain | 1601 | CDH17 | 16.46 | Intron + ve, ASD > 4, Normals < 2, no Sanger filter applied | 283 |
| 8 | 95219409 | 95219588 | 179 | gain | 1619 | CDH17 | 16.46 | Intron + ve, ASD > 4, Normals < 2, no Sanger filter applied | 231 |
| 8 | 95219409 | 95219588 | 179 | gain | 1640 | CDH17 | 16.46 | Intron + ve, ASD > 4, Normals < 2, no Sanger filter applied | 231 |
| 8 | 95219409 | 95219588 | 179 | gain | 1677 | CDH17 | 16.46 | Intron + ve, ASD > 4, Normals < 2, no Sanger filter applied | 231 |
| 8 | 95219409 | 95219588 | 179 | gain | 1708 | CDH17 | 16.46 | Intron + ve, ASD > 4, Normals < 2, no Sanger filter applied | 231 |
| 8 | 95219409 | 95219513 | 104 | gain | 1928 | CDH17 | 16.46 | Intron + ve, ASD > 4, Normals < 2, no Sanger filter applied | 283 |
| 8 | 95219409 | 95219588 | 179 | gain | 1306 | CDH17 | 22.58 | Intron + ve, ASD > 4, Normals < 2, no Sanger filter applied | 231 |
| 8 | 95219409 | 95219588 | 179 | gain | 1308 | CDH17 | 22.58 | Intron + ve, ASD > 4, Normals < 2, no Sanger filter applied | 231 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 8 | 95219409 | 95219588 | 179 | gain | 1394 | CDH17 | 22.58 | Intron +ve, ASD > 4, Normals < 2, no Sanger filter applied | 231 |
| 8 | 95219409 | 95219588 | 179 | gain | 1619 | CDH17 | 22.58 | Intron +ve, ASD > 4, Normals < 2, no Sanger filter applied | 231 |
| 8 | 95219409 | 95219588 | 179 | gain | 1640 | CDH17 | 22.58 | Intron +ve, ASD > 4, Normals < 2, no Sanger filter applied | 231 |
| 8 | 95219409 | 95219588 | 179 | gain | 1677 | CDH17 | 22.58 | Intron +ve, ASD > 4, Normals < 2, no Sanger filter applied | 231 |
| 8 | 95219409 | 95219588 | 179 | gain | 1708 | CDH17 | 22.58 | Intron +ve, ASD > 4, Normals < 2, no Sanger filter applied | 231 |
| 8 | 95219513 | 95219588 | 75 | gain | 1271 | CDH17 | 22.58 | Intron +ve, ASD > 4, Normals < 2, no Sanger filter applied | 230 |
| 8 | 95219513 | 95219588 | 75 | gain | 1389 | CDH17 | 22.58 | Intron +ve, ASD > 4, Normals < 2, no Sanger filter applied | 230 |
| 8 | 95219513 | 95219588 | 75 | gain | 1449 | CDH17 | 22.58 | Intron +ve, ASD > 4, Normals < 2, no Sanger filter applied | 230 |
| 8 | 95219513 | 95227278 | 7765 | loss | 1643 | CDH17 | 22.58 | Intron +ve, ASD > 4, Normals < 2, no Sanger filter applied | 232 |
| 8 | 95219513 | 95219588 | 75 | gain | 1661 | CDH17 | 22.58 | Intron +ve, ASD > 4, Normals < 2, no Sanger filter applied | 230 |
| 8 | 95219513 | 95219588 | 75 | gain | 1814 | CDH17 | 22.58 | Intron +ve, ASD > 4, Normals < 2, no Sanger filter applied | 230 |
| 8 | 95219513 | 95219588 | 75 | gain | 1853 | CDH17 | 22.58 | Intron +ve, ASD > 4, Normals < 2, no Sanger filter applied | 230 |
| 8 | 95219513 | 95219588 | 75 | gain | 1893 | CDH17 | 22.58 | Intron +ve, ASD > 4, Normals < 2, no Sanger filter applied | 230 |
| 8 | 107368178 | 107369802 | 1624 | gain | 1306 | OXR1 | 6.71 | Genic (distinct CNV-subreaions); OR > 6 | 635 |
| 8 | 107368178 | 107369802 | 1624 | gain | 1619 | OXR1 | 6.71 | Genic (distinct CNV-subregions); OR > 6 | 635 |
| 8 | 107605521 | 107616812 | 11291 | loss | 1464 | OXR1 | 6.71 | Genic (distinct CNV-subregions); OR > 6 | 636 |
| 8 | 107605521 | 107616812 | 11291 | gain | 1519 | OXR1 | 6.71 | Genic (distinct CNV-subregions); OR > 6 | 636 |
| 8 | 107605521 | 107616812 | 11291 | gain | 1723 | OXR1 | 6.71 | Genic (distinct CNV-subregions); OR > 6 | 636 |
| 8 | 107697816 | 107699245 | 1429 | gain | 1373 | OXR1 | 6.71 | Genic (distinct CNV-subregions); OR > 6 | 637 |
| 8 | 107697816 | 107701550 | 3734 | gain | 1872 | OXR1 | 6.71 | Genic (distinct CNV-subregions); OR > 6 | 638 |
| 8 | 107697816 | 107701550 | 3734 | gain | 1916 | OXR1 | 6.71 | Genic (distinct CNV-subregions); OR > 6 | 638 |
| 8 | 107697816 | 107701550 | 3734 | gain | 1872 | OXR1 | 6.71 | Genic (distinct CNV-subregions); OR > 6 | 638 |
| 8 | 107697816 | 107701550 | 3734 | gain | 1946 | OXR1 | 6.71 | Genic (distinct CNV-subregions); OR > 6 | 638 |
| 8 | 107737273 | 107739119 | 1846 | loss | 1574 | OXR1 | 6.71 | Genic (distinct CNV-subregions); OR > 6 | 639 |
| 8 | 114408613 | 114415656 | 7043 | loss | 1876 | CSMD3 | 24.12 | Intron +ve, ASD > 4, Normals < 2, no Sanger filter applied | 5 |
| 8 | 114408613 | 114415656 | 7043 | loss | 1878 | CSMD3 | 24.12 | Intron +ve, ASD > 4, Normals < 2, no Sanger filter applied | 5 |
| 8 | 114414403 | 114415656 | 1253 | loss | 1848 | CSMD3 | 24.12 | Intron +ve, ASD > 4, Normals < 2, no Sanger filter applied | 4 |
| 8 | 114414403 | 114415656 | 1253 | loss | 1851 | CSMD3 | 24.12 | Intron +ve, ASD > 4, Normals < 2, no Sanger filter applied | 4 |
| 8 | 111115656 | 114415656 | 1253 | loss | 1855 | CSMD3 | 24.12 | Intron +ve, ASD > 4, Normals < 2, no Sanger filter applied | 1 |
| 8 | 114414403 | 114415656 | 1253 | loss | 1871 | CSMD3 | 24.12 | Intron +ve, ASD > 4, Normals < 2, no Sanger filter applied | 4 |
| 8 | 114414403 | 114415656 | 1253 | loss | 1897 | CSMD3 | 24.12 | Intron +ve, ASD > 4, Normals < 2, no Sanger filter applied | 4 |
| 8 | 114414403 | 114415656 | 1253 | loss | 1902 | CSMD3 | 24.12 | Intron +ve, ASD > 4, Normals < 2, no Sanger filter applied | 4 |
| 8 | 114414403 | 114415656 | 1253 | loss | 1916 | CSMD3 | 24.12 | Intron +ve, ASD > 4, Normals < 2, no Sanger filter applied | 4 |
| 8 | 114414403 | 114415656 | 1253 | loss | 1918 | CSMD3 | 24.12 | Intron +ve, ASD > 4, Normals < 2, no Sanger filter applied | 4 |
| 8 | 114414403 | 114415656 | 1253 | loss | 1921 | CSMD3 | 24.12 | Intron +ve, ASD > 4, Normals < 2, no Sanger filter applied | 4 |
| 8 | 114414403 | 114415656 | 1253 | loss | 1935 | CSMD3 | 24.12 | Intron +ve, ASD > 4, Normals < 2, no Sanger filter applied | 4 |
| 8 | 114414403 | 114415656 | 1253 | loss | 1953 | CSMD3 | 24.12 | Intron +ve, ASD > 4, Normals < 2, no Sanger filter applied | 4 |
| 8 | 114414403 | 114415656 | 1253 | loss | 1969 | CSMD3 | 24.12 | Intron +ve, ASD > 4, Normals < 2, no Sanger filter applied | 4 |
| 8 | 114414403 | 114415656 | 1253 | loss | 1988 | CSMD3 | 24.12 | Intron +ve, ASD > 4, Normals < 2, no Sanger filter applied | 4 |
| 8 | 114414403 | 114415656 | 1253 | loss | 2031 | CSMD3 | 24.12 | Intron +ve, ASD > 4, Normals < 2, no Sanger filter applied | 4 |
| 9 | 19239599 | 19554273 | 314674 | gain | 1418 | ACER2 | 2.95 | Exon +ve, 5 > ASD > 1, Normals > 2, Sanger − ve | 778 |
| 9 | 19415150 | 19434760 | 19610 | gain | 1297 | ACER2 | 2.95 | Exon +ve, 5 > ASD > 1, Normals < 2, Sanger − ve | 777 |
| 9 | 19677387 | 24675102 | 4997715 | loss | 1418 | IFNA22P | 8.91 | Exon +ve, ASD > 4, Normals < 2, no Sanger filter applied | 457 |
| 9 | 21245159 | 21267945 | 22786 | gain | 1798 | IFNA22P | 8.91 | Exon +ve, ASD > 4, Normals < 2, no Sanger filter applied | 459 |
| 9 | 21245159 | 21274020 | 28861 | gain | 2020 | IFNA22P | 8.91 | Exon +ve, ASD > 4, Normals < 2, no Sanger filter applied | 460 |
| 9 | 21250372 | 21267945 | 17573 | gain | 1432 | IFNA22P | 8.91 | Exon +ve, ASD > 4, Normals < 2, no Sanger filter applied | 458 |
| 9 | 21250372 | 21267945 | 17573 | gain | 1485 | IFNA22P | 8.91 | Exon +ve, ASD > 4, Normals < 2, no Sanger filter applied | 458 |
| 9 | 21250372 | 21267945 | 17573 | gain | 1615 | IFNA22P | 8.91 | Exon +ve, ASD > 4, Normals < 2, no Sanger filter applied | 458 |
| 9 | 28533149 | 28557998 | 24849 | loss | 1820 | LINGO2 | 8.91 | Intron +ve, ASD > 4, Normals < 2, no Sanger filter applied | 463 |
| 9 | 28540140 | 28618391 | 78251 | loss | 1309 | LINGO2 | 8.91 | Intron +ve, ASD > 4, Normals < 2, no Sanger filter applied | 461 |
| 9 | 28540140 | 28574335 | 34195 | loss | 1988 | LINGO2 | 8.91 | Intron +ve, ASD > 4, Normals < 2, no Sanger filter applied | 464 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 9 | 28541438 | 28548817 | 7379 | gain | 1530 | LINGO2 | 8.91 | Intron + ve, ASD > 4, Normals < 2, no Sanger filter applied | 462 |
| 9 | 28541438 | 28548817 | 7379 | gain | 1585 | LINGO2 | 8.91 | Intron + ve, ASD > 4, Normals < 2, no Sanger filter applied | 462 |
| 9 | 28541438 | 28548817 | 7379 | gain | 1606 | LINGO2 | 8.91 | Intron + ve, ASD > 4, Normals < 2, no Sanger filter applied | 462 |
| 9 | 71217016 | 71239115 | 21169 | gain | 1829 | APBA1 | 7.42 | Exon + ve, ASD > 4, Normals < 2, no Sanger filter applied | 43 |
| 9 | 71224527 | 71239115 | 14588 | gain | 1558 | APBA1 | 7.42 | Exon + ve, ASD > 4, Normals < 2, no Sanger filter applied | 41 |
| 9 | 71224527 | 71245672 | 21145 | loss | 1639 | APBA1 | 7.42 | Exon + ve, ASD > 4, Normals < 2, no Sanger filter applied | 42 |
| 9 | 71224527 | 71239115 | 14588 | gain | 1904 | APBA1 | 7.42 | Exon + ve, ASD > 4, Normals < 2, no Sanger filter applied | 41 |
| 9 | 71224527 | 71239115 | 14588 | gain | 1970 | APBA1 | 7.42 | Exon + ve, ASD > 4, Normals < 2, no Sanger filter applied | 41 |
| 9 | 73771087 | 73777413 | 6326 | gain | 1855 | C9orf85 | 7.42 | Exon + ve, ASD > 4, Normals < 2, no Sanger filter applied | 583 |
| 9 | 73771087 | 73780717 | 9630 | gain | 1893 | C9orf85 | 7.42 | Exon + ve, ASD > 4, Normals < 2, no Sanger filter applied | 584 |
| 9 | 73771180 | 73777413 | 6233 | gain | 1268 | C9orf85 | 7.42 | Exon + ve, ASD > 4, Normals < 2, no Sanger filter applied | 581 |
| 9 | 73771180 | 73780717 | 9537 | gain | 1793 | C9orf85 | 7.42 | Exon + ve, ASD > 4, Normals < 2, no Sanger filter applied | 582 |
| 9 | 73771180 | 73780717 | 9537 | gain | 1883 | C9orf85 | 7.42 | Exon + ve, ASD > 4, Normals < 2, no Sanger filter applied | 582 |
| 9 | 79033036 | 79047245 | 14209 | gain | 1589 | VPS13A | 5.92 | Exon + ve, 5 > ASD > 1, Normals < 2, Sanger – ve | 643 |
| 9 | 79037727 | 79067111 | 29384 | gain | 1782 | VPS13A | 5.92 | Exon + ve, 5 > ASD > 1, Normals < 2, Sanger – ve | 644 |
| 9 | 79037727 | 79067111 | 29384 | gain | 1897 | VPS13A | 5.92 | Exon + ve, 5 > ASD > 1, Normals < 2, Sanger – ve | 644 |
| 9 | 79037727 | 79067111 | 29384 | gain | 1938 | VPS13A | 5.92 | Exon + ve, 5 > ASD > 1, Normals < 2, Sanger – ve | 644 |
| 9 | 97689541 | 97695268 | 5727 | loss | 1426 | C9orf102 | 7.42 | Intron + ve, ASD > 4, Normals < 2, no Sanger filter applied | 585 |
| 9 | 97689541 | 97695268 | 5727 | loss | 1552 | C9orf102 | 7.42 | Intron + ve, ASD > 4, Normals < 2, no Sanger filter applied | 585 |
| 9 | 97689541 | 97695268 | 5727 | loss | 1580 | C9orf102 | 7.42 | Intron + ve, ASD > 4, Normals < 2, no Sanger filter applied | 585 |
| 9 | 97693397 | 97695268 | 1871 | loss | 1442 | C9orf102 | 7.42 | Intron + ve, ASD > 4, Normals < 2, no Sanger filter applied | 586 |
| 9 | 97693397 | 97695268 | 1871 | loss | 1996 | C9orf102 | 7.42 | Intron + ve, ASD > 4, Normals < 2, no Sanger filter applied | 586 |
| 9 | 107567321 | 107567415 | 94 | loss | 1308 | TMEM38B | 8.91 | Intron + ve, ASD > 4, Normals < 2, no Sanger filter applied | 465 |
| 9 | 107567321 | 107567415 | 94 | loss | 1502 | TMEM38B | 8.91 | Intron + ve, ASD > 4, Normals < 2, no Sanger filter applied | 465 |
| 9 | 107567321 | 107567415 | 94 | loss | 1555 | TMEM38B | 8.91 | Intron + ve, ASD > 4, Normals < 2, no Sanger filter applied | 465 |
| 9 | 107567321 | 107567415 | 94 | loss | 1563 | TMEM38B | 8.91 | Intron + ve, ASD > 4, Normals < 2, no Sanger filter applied | 465 |
| 9 | 107567321 | 107567415 | 94 | gain | 1611 | TMEM38B | 8.91 | Intron + ve, ASD > 4, Normals < 2, no Sanger filter applied | 465 |
| 9 | 107567321 | 107567415 | 94 | loss | 1876 | TMEM38B | 8.91 | Intron + ve, ASD > 4, Normals < 2, no Sanger filter applied | 465 |
| 9 | 111604593 | 111621391 | 16798 | loss | 1475 | PALM2-AKAP2, PALM2 | 10.41 | Intron + ve, ASD > 4, Normals < 2, no Sanger filter applied | 409 |
| 9 | 111604593 | 111621391 | 16798 | loss | 1475 | PALM2-AKAP2, PALM2 | 10.41 | Intron + ve, ASD > 4, Normals < 2, no Sanger filter applied | 109 |
| 9 | 111604593 | 111621391 | 16798 | loss | 1475 | PALM2-AKAP2, PALM2 | 7.42 | Intron + ve, ASD > 4, Normals < 2, no Sanger filter applied | 409 |
| 9 | 111606594 | 111609722 | 3128 | loss | 1227 | PALM2-AKAP2, PALM2 | 10.41 | Intron + ve, ASD > 4, Normals < 2, no Sanger filter applied | 408 |
| 9 | 111606594 | 111609722 | 3128 | loss | 1621 | PALM2-AKAP2, PALM2 | 10.41 | Intron + ve, ASD > 4, Normals < 2, no Sanger filter applied | 408 |
| 9 | 111606594 | 111609722 | 3128 | loss | 1670 | PALM2-AKAP2, PALM2 | 10.41 | Intron + ve, ASD > 4, Normals < 2, no Sanger filter applied | 408 |
| 9 | 111606594 | 111609722 | 3128 | loss | 1805 | PALM2-AKAP2, PALM2 | 10.41 | Intron + ve, ASD > 4, Normals < 2, no Sanger filter applied | 408 |
| 9 | 111606594 | 111613988 | 7394 | loss | 1854 | PALM2-AKAP2, PALM2 | 10.41 | Intron + ve, ASD > 4, Normals < 2, no Sanger filter applied | 410 |
| 9 | 111606594 | 111613988 | 7394 | loss | 1878 | PALM2-AKAP2, PALM2 | 10.41 | Intron + ve, ASD > 4, Normals < 2, no Sanger filter applied | 410 |
| 9 | 111606594 | 111613988 | 7394 | loss | 1805 | PALM2-AKAP2, PALM2 | 10.41 | Intron + ve, ASD > 4, Normals < 2, no Sanger filter applied | 410 |
| 9 | 111606594 | 111613988 | 7394 | loss | 1878 | PALM2-AKAP2, PALM2 | 10.41 | Intron + ve, ASD > 4, Normals < 2, no Sanger filter applied | 410 |
| 9 | 111609722 | 111619128 | 9406 | loss | 1420 | PALM2-AKAP2, PALM2 | 10.41 | Intron + ve, ASD > 4, Normals < 2, no Sanger filter applied | 411 |
| 9 | 111609722 | 111616410 | 6688 | loss | 1516 | PALM2-AKAP2, PALM2 | 10.41 | Intron + ve, ASD > 4, Normals < 2, no Sanger filter applied | 412 |
| 9 | 111609722 | 111619128 | 9406 | gain | 1680 | PALM2-AKAP2, PALM2 | 10.41 | Intron + ve, ASD > 4, Normals < 2, no Sanger filter applied | 411 |
| 9 | 111609722 | 111619128 | 9406 | loss | 1893 | PALM2-AKAP2, PALM2 | 10.41 | Intron + ve, ASD > 4, Normals < 2, no Sanger filter applied | 411 |
| 9 | 111609722 | 111619128 | 9406 | loss | 1420 | PALM2-AKAP2, PALM2 | 7.42 | Intron + ve, ASD > 4, Normals < 2, no Sanger filter applied | 411 |
| 9 | 111609722 | 111616410 | 6688 | loss | 1516 | PALM2-AKAP2, PALM2 | 10.41 | Intron + ve, ASD > 4, Normals < 2, no Sanger filter applied | 412 |
| 9 | 111609722 | 111619128 | 9406 | gain | 1680 | PALM2-AKAP2, PALM2 | 10.41 | Intron + ve, ASD > 4, Normals < 2, no Sanger filter applied | 411 |
| 9 | 111609722 | 111619128 | 9406 | loss | 1893 | PALM2-AKAP2, PALM2 | 10.41 | Intron + ve, ASD > 4, Normals < 2, no Sanger filter applied | 411 |
| 9 | 122900485 | 122906633 | 6148 | loss | 1698 | CEP110 | 10.41 | Intron + ve, ASD > 4, Normals < 2, no Sanger filter applied | 413 |
| 9 | 122900485 | 122906633 | 6148 | loss | 1755 | CEP110 | 10.41 | Intron + ve, ASD > 4, Normals < 2, no Sanger filter applied | 413 |
| 9 | 122900485 | 122906633 | 6148 | loss | 1959 | CEP110 | 10.41 | Intron + ve, ASD > 4, Normals < 2, no Sanger filter applied | 413 |
| 9 | 122900702 | 122906633 | 5931 | loss | 1734 | CEP110 | 10.41 | Intron + ve, ASD > 4, Normals < 2, no Sanger filter applied | 414 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 9 | 122900702 | 122906633 | 5931 | loss | 1762 | CEP110 | 10.41 | Intron + ve, ASD > 4, Normals < 2, no Sanger filter applied | 414 |
| 9 | 122900702 | 122906633 | 5931 | loss | 1952 | CEP110 | 10.41 | Intron + ve, ASD > 4, Normals < 2, no Sanger filter applied | 414 |
| 9 | 122900702 | 122906633 | 5931 | loss | 1964 | CEP110 | 10.41 | Intron + ve, ASD > 4, Normals < 2, no Sanger filter applied | 414 |
| 9 | 134088348 | 134110043 | 21695 | loss | 1639 | NTNG2 | 2.95 | Exon + ve, 5 > ASD > 1, Normals < 2, Sanger − ve | 780 |
| 9 | 134091469 | 134110043 | 18574 | loss | 1230 | NTNG2 | 2.95 | Exon + ve, 5 > ASD > 1, Normals < 2, Sanger − ve | 779 |
| 9 | 134539589 | 134545846 | 6257 | loss | 1345 | GTF3C4 | 2.95 | Exon + ve, 5 > ASD > 1, Normals < 2, Sanger − ve | 781 |
| 9 | 134544331 | 134545846 | 1515 | loss | 2036 | GTF3C4 | 2.95 | Exon + ve, 5 > ASD > 1, Normals < 2, Sanger − ve | 782 |
| 9 | 882548 | 899657 | 17109 | loss | 1293 | LARP4B | 8.91 | Intron + ve, ASD > 4, Normals < 2, no Sanger filter applied | 466 |
| 10 | 885098 | 897387 | 12289 | loss | 1813 | LARP4B | 8.91 | Intron + ve, ASD > 4, Normals < 2, no Sanger filter applied | 467 |
| 10 | 885098 | 897387 | 12289 | loss | 1845 | LARP4B | 8.91 | Intron + ve, ASD > 4, Normals < 2, no Sanger filter applied | 467 |
| 10 | 885098 | 897387 | 12289 | loss | 1855 | LARP4B | 8.91 | Intron + ve, ASD > 4, Normals < 2, no Sanger filter applied | 467 |
| 10 | 885098 | 897387 | 12289 | loss | 1953 | LARP4B | 8.91 | Intron + ve, ASD > 4, Normals < 2, no Sanger filter applied | 467 |
| 10 | 885098 | 897387 | 12289 | loss | 2031 | LARP4B | 8.91 | Intron + ve, ASD > 4, Normals < 2, no Sanger filter applied | 467 |
| 10 | 15026547 | 15055229 | 28682 | gain | 1243 | DCLRE1C | 11.92 | Exon + ve, ASD > 4, Normals < 2, no Sanger filter applied | 332 |
| 10 | 15026547 | 15099650 | 73103 | gain | 1298 | DCLRE1C | 11.92 | Exon + ve, ASD > 4, Normals < 2, no Sanger filter applied | 333 |
| 10 | 15026547 | 15099650 | 73103 | gain | 1760 | DCLRE1C | 11.92 | Exon + ve, ASD > 4, Normals < 2, no Sanger filter applied | 333 |
| 10 | 15026517 | 15099650 | 82963 | gain | 1877 | DCLRE1C | 11.92 | Exon + ve, ASD > 4, Normals < 2, no Sanger filter applied | 335 |
| 10 | 15026517 | 15100510 | 73103 | gain | 1894 | DCLRE1C | 11.92 | Exon + ve, ASD > 4, Normals < 2, no Sanger filter applied | 335 |
| 10 | 15000650 | 15099650 | 73103 | gain | 1910 | DCLRE1C | 11.92 | Exon + ve, ASD > 4, Normals < 2, no Sanger filter applied | 333 |
| 10 | 15026547 | 15099650 | 73103 | gain | 1936 | DCLRE1C | 11.92 | Exon + ve, ASD > 4, Normals < 2, no Sanger filter applied | 333 |
| 10 | 15026547 | 15099650 | 73103 | loss | 1948 | DCLRE1C | 11.92 | Exon + ve, ASD > 4, Normals < 2, no Sanger filter applied | 333 |
| 10 | 15055229 | 15099650 | 28682 | gain | 1243 | MEIG1 | 13.43 | Exon + ve, ASD > 4, Normals < 2, no Sanger filter applied | 332 |
| 10 | 15026547 | 15099650 | 73103 | gain | 1298 | MEIG1 | 13.43 | Exon + ve, ASD > 4, Normals < 2, no Sanger filter applied | 333 |
| 10 | 15026547 | 15099650 | 73103 | gain | 1760 | MEIG1 | 13.43 | Exon + ve, ASD > 4, Normals < 2, no Sanger filter applied | 333 |
| 10 | 15026517 | 15109510 | 82963 | gain | 1877 | MEIG1 | 13.43 | Exon + ve, ASD > 4, Normals < 2, no Sanger filter applied | 335 |
| 10 | 15026517 | 15099650 | 73103 | gain | 1894 | MEIG1 | 13.43 | Exon + ve, ASD > 4, Normals < 2, no Sanger filter applied | 335 |
| 10 | 15000650 | 15099650 | 73103 | gain | 1910 | MEIG1 | 13.43 | Exon + ve, ASD > 4, Normals < 2, no Sanger filter applied | 333 |
| 10 | 15026547 | 15099650 | 73103 | gain | 1936 | MEIG1 | 13.43 | Exon + ve, ASD > 4, Normals < 2, no Sanger filter applied | 333 |
| 10 | 15026547 | 15099650 | 73103 | loss | 1948 | MEIG1 | 11.92 | Exon + ve, ASD > 4, Normals < 2, no Sanger filter applied | 333 |
| 10 | 15055229 | 15099650 | 28682 | gain | 1243 | MEIG1 | 11.92 | Exon + ve, ASD > 4, Normals < 2, no Sanger filter applied | 332 |
| 10 | 15026547 | 15099650 | 73103 | gain | 1298 | MEIG1 | 11.92 | Exon + ve, ASD > 4, Normals < 2, no Sanger filter applied | 333 |
| 10 | 15026547 | 15099650 | 73103 | gain | 1760 | MEIG1 | 11.92 | Exon + ve, ASD > 4, Normals < 2, no Sanger filter applied | 333 |
| 10 | 15026547 | 15099650 | 73103 | gain | 1877 | MEIG1 | 11.92 | Exon + ve, ASD > 4, Normals < 2, no Sanger filter applied | 333 |
| 10 | 15026547 | 15099650 | 73103 | gain | 1894 | MEIG1 | 11.92 | Exon + ve, ASD > 4, Normals < 2, no Sanger filter applied | 333 |
| 10 | 15026547 | 15099650 | 73103 | gain | 1910 | MEIG1 | 11.92 | Exon + ve, ASD > 4, Normals < 2, no Sanger filter applied | 333 |
| 10 | 15026547 | 15099650 | 73103 | gain | 1936 | MEIG1 | 11.92 | Exon + ve, ASD > 4, Normals < 2, no Sanger filter applied | 333 |
| 10 | 15026547 | 15099650 | 73103 | gain | 1948 | MEIG1 | 11.92 | Exon + ve, ASD > 4, Normals < 2, no Sanger filter applied | 333 |
| 10 | 15041059 | 15047327 | 6268 | gain | 1570 | MEIG1 | 13.43 | Exon + ve, ASD > 4, Normals < 2, no Sanger filter applied | 334 |
| 10 | 24564345 | 24586451 | 22106 | gain | 1504 | KIAA1217, PRINS | 2.95 | Exon + ve, 5 > ASD > 1, Normals < 2, Sanger − ve | 783 |
| 10 | 24564345 | 24586451 | 22106 | gain | 1726 | KIAA1217, PRINS | 2.95 | Exon + ve, 5 > ASD > 1, Normals < 2, Sanger − ve | 783 |
| 10 | 41971605 | 43049635 | 1078030 | gain | 1746 | CSGALNACT2, RET | 2.95 | Exon + ve, 5 > ASD > 1, Normals < 2, Sanger − ve | 784 |
| 10 | 41971605 | 43049635 | 1078030 | gain | 1746 | RASGEF1A | 2.95 | Exon + ve, 5 > ASD > 1, Normals < 2, Sanger − ve | 784 |
| 10 | 42601499 | 43277721 | 676222 | gain | 1968 | CSGALNACT2, RET | 2.95 | Exon + ve, 5 > ASD > 1, Normals < 2, Sanger − ve | 785 |
| 10 | 42601499 | 43277721 | 676222 | gain | 1968 | RASGEF1A | 2.95 | Exon + ve, 5 > ASD > 1, Normals < 2, Sanger − ve | 785 |
| 10 | 45478103 | 47017598 | 1539495 | gain | 1408 | ANUBL1 | 5.92 | Exon + ve, 5 > ASD > 1, Normals < 2, Sanger − ve | 646 |
| 10 | 45478103 | 46558272 | 1080169 | gain | 1653 | ANUBL1 | 5.92 | Exon + ve, 5 > ASD > 1, Normals < 2, Sanger − ve | 647 |
| 10 | 45487335 | 46558272 | 1070937 | gain | 1293 | ANUBL1 | 5.92 | Exon + ve, 5 > ASD > 1, Normals < 2, Sanger − ve | 645 |
| 10 | 45487335 | 47172534 | 1685199 | gain | 1832 | ANUBL1 | 5.92 | Exon + ve, 5 > ASD > 1, Normals < 2, Sanger − ve | 648 |
| 10 | 55202411 | 57178733 | 1976322 | gain | 1429 | PCDH15 | 8.91 | Intron + ve, ASD > 4, Normals < 2, no Sanger filter applied | 59 |
| 10 | 55202411 | 57178733 | 1976322 | gain | 1429 | PCDH15 | 7.42 | Intron + ve, ASD > 4, Normals < 2, no Sanger filter applied | 59 |
| 10 | 55202411 | 57178733 | 1976322 | gain | 1129 | MTRNR2L5 | 0.98 | MTRNR2L_family | 59 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 10 | 56114489 | 56156253 | 41764 | loss | 1684 | PCDH15 | 8.91 | Intron + ve, ASD > 4, Normals < 2, no Sanger filter applied | 470 |
| 10 | 56114489 | 56156253 | 41764 | loss | 1684 | PCDH15 | 7.42 | Intron + ve, ASD > 4, Normals < 2, no Sanger filter applied | 470 |
| 10 | 56120991 | 56154328 | 33337 | gain | 1605 | PCDH15 | 8.91 | Intron + ve, ASD > 4, Normals < 2, no Sanger filter applied | 468 |
| 10 | 56120991 | 56154328 | 33337 | gain | 1897 | PCDH15 | 7.42 | Intron + ve, ASD > 4, Normals < 2, no Sanger filter applied | 468 |
| 10 | 56120991 | 56154328 | 33337 | gain | 1605 | PCDH15 | 7.42 | Intron + ve, ASD > 4, Normals < 2, no Sanger filter applied | 468 |
| 10 | 56120991 | 56164820 | 42403 | loss | 1897 | PCDH15 | 8.91 | Intron + ve, ASD > 4, Normals < 2, no Sanger filter applied | 469 |
| 10 | 56122417 | 56142414 | 19997 | gain | 1935 | PCDH15 | 8.91 | Intron + ve, ASD > 4, Normals < 2, no Sanger filter applied | 171 |
| 10 | 56122417 | 56164820 | 42403 | loss | 1631 | PCDH15 | 7.42 | Intron + ve, ASD > 4, Normals < 2, no Sanger filter applied | 469 |
| 10 | 57021814 | 57031555 | 9741 | loss | 1583 | MTRNR2L5 | 0.98 | MTRNR2L_family | 60 |
| 10 | 67723300 | 67878684 | 155384 | loss | 1446 | CTNNA3 | 2.95 | Exon + ve, ASD > 1, Normals < 2, Sanger − ve | 787 |
| 10 | 67803521 | 67902637 | 99116 | loss | 1441 | CTNNA3 | 2.95 | Exon + ve, ASD > 1, Normals < 2, Sanger − ve | 786 |
| 10 | 77916218 | 77928738 | 12520 | gain | 1272 | C10orf11 | 24.12 | Intron + ve, ASD > 4, Normals < 2, no Sanger filter applied | 198 |
| 10 | 77916218 | 77928738 | 12520 | loss | 1305 | C10orf11 | 24.12 | Intron + ve, ASD > 4, Normals < 2, no Sanger filter applied | 198 |
| 10 | 77916218 | 77928669 | 12451 | loss | 1321 | C10orf11 | 24.12 | Intron + ve, ASD > 4, Normals < 2, no Sanger filter applied | 199 |
| 10 | 77916218 | 77928758 | 12520 | loss | 1347 | C10orf11 | 24.12 | Intron + ve, ASD > 4, Normals < 2, no Sanger filter applied | 198 |
| 10 | 77916218 | 77928738 | 12520 | loss | 1389 | C10orf11 | 24.12 | Intron + ve, ASD > 4, Normals < 2, no Sanger filter applied | 198 |
| 10 | 77916218 | 77928738 | 12520 | gain | 1426 | C10orf11 | 24.12 | Intron + ve, ASD > 4, Normals < 2, no Sanger filter applied | 200 |
| 10 | 77916218 | 77942809 | 26501 | loss | 1455 | C10orf11 | 24.12 | Intron + ve, ASD > 4, Normals < 2, no Sanger filter applied | 198 |
| 10 | 77916218 | 77928738 | 12520 | loss | 1504 | C10orf11 | 24.12 | Intron + ve, ASD > 4, Normals < 2, no Sanger filter applied | 198 |
| 10 | 77916218 | 77940201 | 23983 | loss | 1517 | C10orf11 | 24.12 | Intron + ve, ASD > 4, Normals < 2, no Sanger filter applied | 201 |
| 10 | 77916218 | 77928738 | 12520 | loss | 1567 | C10orf11 | 24.12 | Intron + ve, ASD > 4, Normals < 2, no Sanger filter applied | 198 |
| 10 | 77916218 | 77928738 | 12520 | loss | 1574 | C10orf11 | 24.12 | Intron + ve, ASD > 4, Normals < 2, no Sanger filter applied | 198 |
| 10 | 77916218 | 77926390 | 12520 | gain | 1582 | C10orf11 | 24.12 | Intron + ve, ASD > 4, Normals < 2, no Sanger filter applied | 203 |
| 10 | 77916218 | 77928738 | 12520 | loss | 1592 | C10orf11 | 24.12 | Intron + ve, ASD > 4, Normals < 2, no Sanger filter applied | 198 |
| 10 | 77916218 | 77928738 | 12520 | gain | 1598 | C10orf11 | 24.12 | Intron + ve, ASD > 4, Normals < 2, no Sanger filter applied | 198 |
| 10 | 77916218 | 77917893 | 1675 | loss | 1743 | C10orf11 | 24.12 | Intron + ve, ASD > 4, Normals < 2, no Sanger filter applied | 204 |
| 10 | 77916218 | 77928738 | 12520 | gain | 1748 | C10orf11 | 24.12 | Intron + ve, ASD > 4, Normals < 2, no Sanger filter applied | 198 |
| 10 | 77916218 | 77940201 | 23983 | gain | 1272 | C10orf11 | 24.12 | Intron + ve, ASD > 4, Normals < 2, no Sanger filter applied | 201 |
| 10 | 77916218 | 77928738 | 12520 | gain | 1305 | C10orf11 | 31.9 | Intron + ve, ASD > 4, Normals < 2, no Sanger filter applied | 198 |
| 10 | 77916218 | 77928738 | 12520 | loss | 1321 | C10orf11 | 31.9 | Intron + ve, ASD > 4, Normals < 2, no Sanger filter applied | 198 |
| 10 | 77916218 | 77928669 | 12451 | loss | 1347 | C10orf11 | 31.9 | Intron + ve, ASD > 4, Normals < 2, no Sanger filter applied | 199 |
| 10 | 77916218 | 77928738 | 12520 | loss | 1389 | C10orf11 | 31.9 | Intron + ve, ASD > 4, Normals < 2, no Sanger filter applied | 198 |
| 10 | 77916218 | 77942809 | 26591 | loss | 1426 | C10orf11 | 31.9 | Intron + ve, ASD > 4, Normals < 2, no Sanger filter applied | 198 |
| 10 | 77916218 | 77928738 | 12520 | loss | 1455 | C10orf11 | 31.9 | Intron + ve, ASD > 4, Normals < 2, no Sanger filter applied | 198 |
| 10 | 77916218 | 77928738 | 12520 | loss | 1504 | C10orf11 | 31.9 | Intron + ve, ASD > 4, Normals < 2, no Sanger filter applied | 198 |
| 10 | 77916218 | 77940201 | 23983 | loss | 1517 | C10orf11 | 31.9 | Intron + ve, ASD > 4, Normals < 2, no Sanger filter applied | 201 |
| 10 | 77916218 | 77928738 | 12520 | loss | 1567 | C10orf11 | 31.9 | Intron + ve, ASD > 4, Normals < 2, no Sanger filter applied | 198 |
| 10 | 77916218 | 77928738 | 12520 | loss | 1574 | C10orf11 | 31.9 | Intron + ve, ASD > 4, Normals < 2, no Sanger filter applied | 198 |
| 10 | 77916218 | 77926390 | 10172 | gain | 1582 | C10orf11 | 31.9 | Intron + ve, ASD > 4, Normals < 2, no Sanger filter applied | 203 |
| 10 | 77916218 | 77928738 | 12520 | loss | 1592 | C10orf11 | 31.9 | Intron + ve, ASD > 4, Normals < 2, no Sanger filter applied | 198 |
| 10 | 77916218 | 77928738 | 12520 | gain | 1598 | C10orf11 | 31.9 | Intron + ve, ASD > 4, Normals < 2, no Sanger filter applied | 198 |
| 10 | 77916218 | 77917893 | 1675 | loss | 1743 | C10orf11 | 31.9 | Intron + ve, ASD > 4, Normals < 2, no Sanger filter applied | 204 |
| 10 | 77916218 | 77928738 | 12520 | gain | 1748 | C10orf11 | 31.9 | Intron + ve, ASD > 4, Normals < 2, no Sanger filter applied | 198 |
| 10 | 77916218 | 77940201 | 23983 | gain | 1426 | C10orf11 | 31.9 | Intron + ve, ASD > 4, Normals < 2, no Sanger filter applied | 201 |
| 10 | 77916218 | 77942809 | 26591 | loss | 1504 | C10orf11 | 13.43 | Intron + ve, ASD > 4, Normals < 2, no Sanger filter applied | 200 |
| 10 | 77916218 | 77940201 | 23983 | loss | 1748 | C10orf11 | 13.43 | Intron + ve, ASD > 4, Normals < 2, no Sanger filter applied | 201 |
| 10 | 77916218 | 77942809 | 26591 | loss | 1426 | C10orf11 | 13.43 | Intron + ve, ASD > 4, Normals < 2, no Sanger filter applied | 200 |
| 10 | 77916218 | 77942809 | 26591 | gain | 1540 | C10orf11 | 8.91 | Intron + ve, ASD > 4, Normals < 2, no Sanger filter applied | 200 |
| 10 | 77917870 | 77928738 | 10868 | gain | 1606 | C10orf11 | 31.9 | Intron + ve, ASD > 4, Normals < 2, no Sanger filter applied | 202 |
| 10 | 77917870 | 77928738 | 10868 | gain | 1733 | C10orf11 | 31.9 | Intron + ve, ASD > 4, Normals < 2, no Sanger filter applied | 202 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 10 | 77917870 | 77942809 | 24939 | gain | 1755 | C10orf11 | 31.9 | Intron + ve, ASD > 4, Normals < 2, no Sanger filter applied | 205 |
| 10 | 77917870 | 77928738 | 10868 | gain | 1893 | C10orf11 | 31.9 | Intron + ve, ASD > 4, Normals < 2, no Sanger filter applied | 202 |
| 10 | 77917870 | 77942809 | 24939 | gain | 1755 | C10orf11 | 13.43 | Intron + ve, ASD > 4, Normals < 2, no Sanger filter applied | 205 |
| 10 | 77926390 | 77940201 | 13811 | gain | 1755 | C10orf11 | 8.91 | Intron + ve, ASD > 4, Normals < 2, no Sanger filter applied | 336 |
| 10 | 77926390 | 77942809 | 16419 | gain | 1267 | C10orf11 | 13.43 | Intron + ve, ASD > 4, Normals < 2, no Sanger filter applied | 337 |
| 10 | 77926390 | 77942809 | 16419 | gain | 1279 | C10orf11 | 13.43 | Intron + ve, ASD > 4, Normals < 2, no Sanger filter applied | 337 |
| 10 | 77926390 | 77942809 | 16419 | gain | 1667 | C10orf11 | 13.43 | Intron + ve, ASD > 4, Normals < 2, no Sanger filter applied | 337 |
| 10 | 77926390 | 77942809 | 16419 | gain | 1728 | C10orf11 | 13.43 | Intron + ve, ASD > 4, Normals < 2, no Sanger filter applied | 337 |
| 10 | 77926390 | 77942809 | 16419 | gain | 1766 | C10orf11 | 13.43 | Intron + ve, ASD > 4, Normals < 2, no Sanger filter applied | 337 |
| 10 | 77926390 | 77942809 | 16419 | gain | 1279 | C10orf11 | 8.91 | Intron + ve, ASD > 4, Normals < 2, no Sanger filter applied | 337 |
| 10 | 77926390 | 77942809 | 16419 | gain | 1667 | C10orf11 | 8.91 | Intron + ve, ASD > 4, Normals < 2, no Sanger filter applied | 337 |
| 10 | 77926390 | 77942809 | 16419 | gain | 1728 | C10orf11 | 8.91 | Intron + ve, ASD > 4, Normals < 2, no Sanger filter applied | 337 |
| 10 | 77926390 | 77942809 | 16419 | gain | 1766 | C10orf11 | 8.91 | Intron + ve, ASD > 4, Normals < 2, no Sanger filter applied | 337 |
| 10 | 108856357 | 108866593 | 10236 | loss | 1269 | SORCS1 | 13.43 | Intron + ve, ASD > 4, Normals < 2, no Sanger filter applied | 338 |
| 10 | 108856357 | 108866593 | 10236 | loss | 1299 | SORCS1 | 13.43 | Intron + ve, ASD > 4, Normals < 2, no Sanger filter applied | 338 |
| 10 | 108856357 | 108866593 | 10236 | loss | 1315 | SORCS1 | 13.43 | Intron + ve, ASD > 4, Normals < 2, no Sanger filter applied | 338 |
| 10 | 108856357 | 108866593 | 10236 | loss | 1465 | SORCS1 | 13.43 | Intron + ve, ASD > 4, Normals < 2, no Sanger filter applied | 338 |
| 10 | 108856357 | 108866593 | 10236 | loss | 1492 | SORCS1 | 13.43 | Intron + ve, ASD > 4, Normals < 2, no Sanger filter applied | 338 |
| 10 | 108856357 | 108866703 | 10346 | loss | 1495 | SORCS1 | 13.43 | Intron + ve, ASD > 4, Normals < 2, no Sanger filter applied | 339 |
| 10 | 108856357 | 108866593 | 10236 | loss | 1566 | SORCS1 | 13.43 | Intron + ve, ASD > 4, Normals < 2, no Sanger filter applied | 338 |
| 10 | 108856357 | 108866593 | 10236 | loss | 1720 | SORCS1 | 13.43 | Intron + ve, ASD > 4, Normals < 2, no Sanger filter applied | 338 |
| 10 | 108856357 | 108866593 | 10236 | loss | 1758 | SORCS1 | 13.43 | Intron + ve, ASD > 4, Normals < 2, no Sanger filter applied | 338 |
| 10 | 116940096 | 116971507 | 31411 | gain | 1394 | ATRNL1 | 11.92 | Intron + ve, ASD > 4, Normals < 2, no Sanger filter applied | 286 |
| 10 | 116940096 | 116958657 | 18561 | gain | 1409 | ATRNL1 | 11.92 | Intron + ve, ASD > 4, Normals < 2, no Sanger filter applied | 287 |
| 10 | 116940096 | 116958657 | 18561 | gain | 1410 | ATRNL1 | 11.92 | Intron + ve, ASD > 4, Normals < 2, no Sanger filter applied | 287 |
| 10 | 116940096 | 116963861 | 23765 | gain | 1416 | ATRNL1 | 11.92 | Intron + ve, ASD > 4, Normals < 2, no Sanger filter applied | 288 |
| 10 | 116940096 | 116953711 | 13615 | gain | 1438 | ATRNL1 | 11.92 | Intron + ve, ASD > 4, Normals < 2, no Sanger filter applied | 289 |
| 10 | 116940096 | 116958657 | 18561 | gain | 1603 | ATRNL1 | 11.92 | Intron + ve, ASD > 4, Normals < 2, no Sanger filter applied | 287 |
| 10 | 116940096 | 116958657 | 18561 | gain | 1834 | ATRNL1 | 11.92 | Intron + ve, ASD > 4, Normals < 2, no Sanger filter applied | 287 |
| 10 | 116940096 | 116971507 | 31411 | gain | 1924 | ATRNL1 | 11.92 | Intron + ve, ASD > 4, Normals < 2, no Sanger filter applied | 286 |
| 10 | 116940096 | 116971507 | 31411 | gain | 1394 | ATRNL1 | 16.46 | Intron + ve, ASD > 4, Normals < 2, no Sanger filter applied | 286 |
| 10 | 116940096 | 116958657 | 18561 | gain | 1409 | ATRNL1 | 16.46 | Intron + ve, ASD > 4, Normals < 2, no Sanger filter applied | 287 |
| 10 | 116940096 | 116958657 | 18561 | gain | 1410 | ATRNL1 | 16.46 | Intron + ve, ASD > 4, Normals < 2, no Sanger filter applied | 287 |
| 10 | 116940096 | 116963861 | 23765 | gain | 1416 | ATRNL1 | 16.46 | Intron + ve, ASD > 4, Normals < 2, no Sanger filter applied | 288 |
| 10 | 116940096 | 116953711 | 13615 | gain | 1438 | ATRNL1 | 16.46 | Intron + ve, ASD > 4, Normals < 2, no Sanger filter applied | 289 |
| 10 | 116940096 | 116958657 | 18561 | gain | 1603 | ATRNL1 | 16.46 | Intron + ve, ASD > 4, Normals < 2, no Sanger filter applied | 287 |
| 10 | 116940096 | 116958657 | 18561 | gain | 1834 | ATRNL1 | 16.46 | Intron + ve, ASD > 4, Normals < 2, no Sanger filter applied | 287 |
| 10 | 116940096 | 116971507 | 31411 | gain | 1924 | ATRNL1 | 16.46 | Intron + ve, ASD > 4, Normals < 2, no Sanger filter applied | 286 |
| 10 | 116940096 | 116971507 | 31411 | gain | 1394 | ATRNL1 | 16.46 | Intron + ve, ASD > 4, Normals < 2, no Sanger filter applied | 286 |
| 10 | 116940096 | 116958657 | 18561 | gain | 1409 | ATRNL1 | 16.46 | Intron + ve, ASD > 4, Normals < 2, no Sanger filter applied | 287 |
| 10 | 116940096 | 116958657 | 18561 | gain | 1410 | ATRNL1 | 16.46 | Intron + ve, ASD > 4, Normals < 2, no Sanger filter applied | 287 |
| 10 | 116940096 | 116963861 | 23765 | gain | 1416 | ATRNL1 | 16.46 | Intron + ve, ASD > 4, Normals < 2, no Sanger filter applied | 288 |
| 10 | 116940096 | 116958657 | 18561 | gain | 1603 | ATRNL1 | 16.46 | Intron + ve, ASD > 4, Normals < 2, no Sanger filter applied | 287 |
| 10 | 116910096 | 116971507 | 31411 | gain | 1834 | ATRNL1 | 16.46 | Intron + ve, ASD > 4, Normals < 2, no Sanger filter applied | 286 |
| 10 | 116940096 | 116971507 | 31411 | gain | 1924 | ATRNL1 | 8.91 | Intron + ve, ASD > 4, Normals < 2, no Sanger filter applied | 286 |
| 10 | 116940096 | 116963861 | 23765 | gain | 1416 | ATRNL1 | 8.91 | Intron + ve, ASD > 4, Normals < 2, no Sanger filter applied | 288 |
| 10 | 116940096 | 116971507 | 31411 | gain | 1834 | ATRNL1 | 8.91 | Intron + ve, ASD > 4, Normals < 2, no Sanger filter applied | 286 |
| 10 | 116940096 | 116971507 | 31411 | gain | 1924 | ATRNL1 | 8.91 | Intron + ve, ASD > 4, Normals < 2, no Sanger filter applied | 286 |
| 10 | 116949327 | 116971507 | 22180 | gain | 1292 | ATRNL1 | 16.46 | Intron + ve, ASD > 4, Normals < 2, no Sanger filter applied | 284 |
| 10 | 116949327 | 116958657 | 9330 | gain | 1346 | ATRNL1 | 16.46 | Intron + ve, ASD > 4, Normals < 2, no Sanger filter applied | 285 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 10 | 116949327 | 116971507 | 22180 | gain | 1880 | ATRNL1 | 16.46 | Intron + ve, ASD > 4, Normals < 2, no Sanger filter applied | 284 |
| 10 | 116949327 | 116971507 | 22180 | gain | 1292 | ATRNL1 | 16.46 | Intron + ve, ASD > 4, Normals < 2, no Sanger filter applied | 284 |
| 10 | 116949327 | 116958657 | 9330 | gain | 1346 | ATRNL1 | 16.46 | Intron + ve, ASD > 4, Normals < 2, no Sanger filter applied | 285 |
| 10 | 116949327 | 116971507 | 22180 | gain | 1880 | ATRNL1 | 16.46 | Intron + ve, ASD > 4, Normals < 2, no Sanger filter applied | 284 |
| 10 | 116949327 | 116971507 | 22180 | gain | 1292 | ATRNL1 | 8.91 | Intron + ve, ASD > 4, Normals < 2, no Sanger filter applied | 284 |
| 10 | 116949327 | 116971507 | 22180 | gain | 1880 | ATRNL1 | 8.91 | Intron + ve, ASD > 4, Normals < 2, no Sanger filter applied | 284 |
| 10 | 116953711 | 116958657 | 4946 | gain | 1761 | ATRNL1 | 16.46 | Intron + ve, ASD > 4, Normals < 2, no Sanger filter applied | 290 |
| 11 | 4926583 | 4934594 | 8011 | gain | 1273 | OR51A2 | 21.04 | Exon + ve, ASD > 4, Normals < 2, no Sanger filter applied | 234 |
| 11 | 4926583 | 4946289 | 19706 | gain | 1304 | OR51A2 | 21.04 | Exon + ve, ASD > 4, Normals < 2, no Sanger filter applied | 235 |
| 11 | 4926583 | 4946289 | 19706 | gain | 1346 | OR51A2 | 21.04 | Exon + ve, ASD > 4, Normals < 2, no Sanger filter applied | 235 |
| 11 | 4926583 | 4951962 | 25379 | gain | 1436 | OR51A2 | 21.04 | Exon + ve, ASD > 4, Normals < 2, no Sanger filter applied | 236 |
| 11 | 4926583 | 4934594 | 8011 | gain | 1453 | OR51A2 | 21.04 | Exon + ve, ASD > 4, Normals < 2, no Sanger filter applied | 234 |
| 11 | 4926583 | 4934594 | 8011 | gain | 1577 | OR51A2 | 21.04 | Exon + ve, ASD > 4, Normals < 2, no Sanger filter applied | 234 |
| 11 | 4926583 | 4946289 | 19706 | gain | 1504 | OR51A2 | 21.04 | Exon + ve, ASD > 4, Normals < 2, no Sanger filter applied | 235 |
| 11 | 4926583 | 4950282 | 23699 | gain | 1669 | OR51A2 | 21.04 | Exon + ve, ASD > 4, Normals < 2, no Sanger filter applied | 237 |
| 11 | 4926583 | 4946289 | 19706 | gain | 1744 | OR51A2 | 21.04 | Exon + ve, ASD > 4, Normals < 2, no Sanger filter applied | 235 |
| 11 | 4926583 | 4951962 | 25379 | gain | 1813 | OR51A2 | 21.04 | Exon + ve, ASD > 4, Normals < 2, no Sanger filter applied | 336 |
| 11 | 4926583 | 4949093 | 22510 | gain | 1858 | OR51A2 | 21.04 | Exon + ve, ASD > 4, Normals < 2, no Sanger filter applied | 238 |
| 11 | 4926583 | 4934594 | 8011 | gain | 1880 | OR51A2 | 21.04 | Exon + ve, ASD > 4, Normals < 2, no Sanger filter applied | 234 |
| 11 | 4926583 | 4931594 | 8011 | gain | 1916 | OR51A2 | 21.04 | Exon + ve, ASD > 4, Normals < 2, no Sanger filter applied | 234 |
| 11 | 4926583 | 4934594 | 8011 | gain | 1960 | OR51A2 | 21.04 | Exon + ve, ASD > 4, Normals < 2, no Sanger filter applied | 234 |
| 11 | 4926583 | 4934594 | 8011 | gain | 1424 | OR51A2 | 21.04 | Exon + ve, ASD > 4, Normals < 2, no Sanger filter applied | 234 |
| 11 | 5226853 | 5230363 | 3510 | gain | 1486 | HBG1 | 7.42 | Exon + ve, ASD > 4, Normals < 2, no Sanger filter applied | 587 |
| 11 | 5226853 | 5230363 | 3510 | gain | 1758 | HBG1 | 7.42 | Exon + ve, ASD > 4, Normals < 2, no Sanger filter applied | 587 |
| 11 | 5226853 | 5230363 | 3510 | gain | 1843 | HBG1 | 7.42 | Exon + ve, ASD > 4, Normals < 2, no Sanger filter applied | 587 |
| 11 | 5226853 | 5230363 | 3510 | gain | 1911 | HBG1 | 7.42 | Exon + ve, ASD > 4, Normals < 2, no Sanger filter applied | 587 |
| 11 | 5738494 | 5766615 | 28121 | gain | 1438 | OR52N1 | 33.47 | Exon + ve, ASD > 4, Normals < 2, no Sanger filter applied | 194 |
| 11 | 5742476 | 5774108 | 31632 | gain | 1394 | OR52N1 | 33.47 | Exon + ve, ASD > 4, Normals < 2, no Sanger filter applied | 192 |
| 11 | 5742476 | 5766615 | 24139 | gain | 1434 | OR52N1 | 33.47 | Exon + ve, ASD > 4, Normals < 2, no Sanger filter applied | 193 |
| 11 | 5742476 | 5774108 | 31632 | gain | 1536 | OR52N1 | 33.47 | Exon + ve, ASD > 4, Normals < 2, no Sanger filter applied | 192 |
| 11 | 5742476 | 5775970 | 33494 | gain | 1538 | OR52N1 | 33.47 | Exon + ve, ASD > 4, Normals < 2, no Sanger filter applied | 195 |
| 11 | 5742476 | 5775970 | 33494 | gain | 1551 | OR52N1 | 33.47 | Exon + ve, ASD > 4, Normals < 2, no Sanger filter applied | 195 |
| 11 | 5742476 | 5766615 | 24139 | gain | 1643 | OR52N1 | 33.47 | Exon + ve, ASD > 4, Normals < 2, no Sanger filter applied | 193 |
| 11 | 5742476 | 5766615 | 24139 | gain | 1712 | OR52N1 | 33.47 | Exon + ve, ASD > 4, Normals < 2, no Sanger filter applied | 193 |
| 11 | 5742476 | 5775970 | 33494 | gain | 1727 | OR52N1 | 33.47 | Exon + ve, ASD > 4, Normals < 2, no Sanger filter applied | 195 |
| 11 | 5742476 | 5766615 | 24139 | gain | 1817 | OR52N1 | 33.47 | Exon + ve, ASD > 4, Normals < 2, no Sanger filter applied | 193 |
| 11 | 5742476 | 5774108 | 31632 | gain | 1821 | OR52N1 | 33.47 | Exon + ve, ASD > 4, Normals < 2, no Sanger filter applied | 192 |
| 11 | 5742476 | 5774108 | 31632 | gain | 1823 | OR52N1 | 33.47 | Exon + ve, ASD > 4, Normals < 2, no Sanger filter applied | 192 |
| 11 | 5742476 | 5775970 | 33494 | gain | 1824 | OR52N1 | 33.47 | Exon + ve, ASD > 4, Normals < 2, no Sanger filter applied | 195 |
| 11 | 5742476 | 5775970 | 33494 | gain | 1825 | OR52N1 | 33.47 | Exon + ve, ASD > 4, Normals < 2, no Sanger filter applied | 195 |
| 11 | 5742476 | 5774108 | 31632 | gain | 1902 | OR52N1 | 33.47 | Exon + ve, ASD > 4, Normals < 2, no Sanger filter applied | 192 |
| 11 | 5742476 | 5774108 | 31632 | gain | 1903 | OR52N1 | 33.47 | Exon + ve, ASD > 4, Normals < 2, no Sanger filter applied | 192 |
| 11 | 5742476 | 5766615 | 24139 | gain | 1991 | OR52N1 | 33.47 | Exon + ve, ASD > 4, Normals < 2, no Sanger filter applied | 193 |
| 11 | 5742176 | 5766615 | 24139 | gain | 2033 | OR52N1 | 33.47 | Exon * ve, ASD > 4, Normals < 2, no Sanger filter applied | 193 |
| 11 | 5742176 | 5766615 | 24139 | gain | 2044 | OR52N1 | 33.47 | Exon + ve, ASD > 4, Normals < 2, no Sanger filter applied | 193 |
| 11 | 5744034 | 5766615 | 22581 | gain | 1877 | OR52N1 | 33.47 | Exon + ve, ASD > 4, Normals < 2, no Sanger Filter applied | 197 |
| 11 | 5745329 | 5766615 | 21286 | gain | 1671 | OR52N1 | 33.47 | Exon + ve, ASD > 4, Normals < 2, no Sanger filter applied | 196 |
| 11 | 5749258 | 5766615 | 17357 | gain | 1235 | OR52N1 | 33.47 | Exon + ve, ASD > 4, Normals < 2, no Sanger filter applied | 191 |
| 11 | 5828251 | 5839924 | 11673 | loss | 1723 | OR52E8 | 10.41 | Exon + ve, ASD > 4, Normals < 2, no Sanger filter applied | 36 |
| 11 | 5832681 | 5839924 | 7243 | loss | 1574 | OR52E8 | 10.41 | Exon + ve, ASD > 4, Normals < 2, no Sanger filter applied | 35 |
| 11 | 5832681 | 5839924 | 7243 | loss | 1769 | OR52E8 | 10.41 | Exon + ve, ASD > 4, Normals < 2, no Sanger filter applied | 35 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 11 | 5832681 | 5839924 | 7243 | loss | 1856 | OR52E8 | 10.41 | Exon + ve, ASD > 4, Normals < 2, no Sanger filter applied | 35 |
| 11 | 5832681 | 5839924 | 7243 | loss | 1858 | OR52E8 | 10.41 | Exon + ve, ASD > 4, Normals < 2, no Sanger filter applied | 35 |
| 11 | 5832681 | 5839924 | 7243 | loss | 1877 | OR52E8 | 10.41 | Exon + ve, ASD > 4, Normals < 2, no Sanger filter applied | 35 |
| 11 | 5832681 | 5839924 | 7243 | loss | 2034 | OR52E8 | 10.41 | Exon + ve, ASD > 4, Normals < 2, no Sanger filter applied | 35 |
| 11 | 9971600 | 10068699 | 697099 | loss | 1959 | MRV1l, LYVE1, AMPD3, MTRNR2L8, LOC100129827, SBF2, RNF141, ADM | 1.47 | MTRNR2L_family | 61 |
| 11 | 34919050 | 34920722 | 1672 | loss | 1285 | PDHX | 7.42 | Intron + ve, ASD > 4, Normals < 2, no Sanger filter applied | 588 |
| 11 | 34919050 | 34920722 | 1672 | loss | 1572 | PDHX | 7.42 | Intron + ve, ASD > 4, Normals < 2, no Sanger filter applied | 588 |
| 11 | 34919050 | 34920722 | 1672 | loss | 1590 | PDHX | 7.42 | Intron + ve, ASD > 4, Normals < 2, no Sanger filter applied | 588 |
| 11 | 34919050 | 34920722 | 1672 | loss | 1688 | PDHX | 7.42 | Intron + ve, ASD > 4, Normals < 2, no Sanger filter applied | 588 |
| 11 | 34919050 | 34919798 | 748 | loss | 1737 | PDHX | 7.42 | Intron + ve, ASD > 4, Normals < 2, no Sanger filter applied | 589 |
| 11 | 51235737 | 51371826 | 136089 | gain | 1708 | OR4C46 | 2.95 | Exon + ve, 5 > ASD > 1, Normals < 2, Sanger − ve | 788 |
| 11 | 51235737 | 51785063 | 3519326 | gain | 1943 | OR4C46 | 2.95 | Exon + ve, 5 > ASD > 1, Normals < 2, Sanger − ve | 789 |
| 11 | 55112618 | 55177650 | 65032 | gain | 1296 | | 49.43 | high OR intergenic (OR > 30) | 852 |
| 11 | 55112618 | 55202450 | 89832 | gain | 1542 | | 49.43 | high OR intergenic (OR > 30) | 855 |
| 11 | 55112618 | 55219985 | 107367 | gain | 1545 | | 49.43 | high OR intergenic (OR > 30) | 854 |
| 11 | 55112618 | 55196550 | 83932 | gain | 1590 | | 49.43 | high OR intergenic (OR > 30) | 856 |
| 11 | 55112618 | 55196550 | 83932 | gain | 1608 | | 49.43 | high OR intergenic (OR > 30) | 856 |
| 11 | 55112618 | 55219985 | 107367 | gain | 1721 | | 49.43 | high OR intergenic (OR > 30) | 851 |
| 11 | 55113618 | 55219985 | 107367 | gain | 1750 | | 49.43 | high OR intergenic (OR > 30) | 854 |
| 11 | 55112618 | 55219985 | 107367 | gain | 1755 | | 49.43 | high OR intergenic (OR > 30) | 854 |
| 11 | 55112618 | 55219985 | 107367 | gain | 1787 | | 49.43 | high OR intergenic (OR > 30) | 854 |
| 11 | 55112618 | 55209626 | 97008 | gain | 1792 | | 49.43 | high OR intergenic (OR > 30) | 854 |
| 11 | 55112618 | 55203706 | 91088 | gain | 1807 | | 49.43 | high OR intergenic (OR > 30) | 860 |
| 11 | 55112618 | 55219985 | 107367 | gain | 1862 | | 49.43 | high OR intergenic (OR > 30) | 861 |
| 11 | 55112618 | 55223056 | 110438 | gain | 1870 | | 49.43 | high OR intergenic (OR > 30) | 854 |
| 11 | 55112618 | 55219985 | 107367 | gain | 1900 | | 49.43 | high OR intergenic (OR > 30) | 854 |
| 11 | 55112618 | 55219985 | 107367 | gain | 1937 | | 49.43 | high OR intergenic (OR > 30) | 862 |
| 11 | 55112618 | 55219985 | 107367 | gain | 1998 | | 49.43 | high OR intergenic (OR > 30) | 854 |
| 11 | 55112618 | 55219985 | 107367 | gain | 2026 | | 49.43 | high OR intergenic (OR > 30) | 854 |
| 11 | 55114405 | 55205278 | 92660 | gain | 2030 | | 49.43 | high OR intergenic (OR > 30) | 863 |
| 11 | 55114405 | 55207305 | 92900 | gain | 1222 | | 49.43 | high OR intergenic (OR > 30) | 850 |
| 11 | 55114405 | 55219985 | 105580 | gain | 1230 | | 49.43 | high OR intergenic (OR > 30) | 851 |
| 11 | 55114405 | 55196550 | 82145 | gain | 1271 | | 49.43 | high OR intergenic (OR > 30) | 853 |
| 11 | 55114405 | 55219985 | 105580 | gain | 1285 | | 49.43 | high OR intergenic (OR > 30) | 851 |
| 11 | 55114405 | 55203706 | 89301 | gain | 1607 | | 49.43 | high OR intergenic (OR > 30) | 857 |
| 11 | 55114405 | 55209626 | 95221 | gain | 1711 | | 49.43 | high OR intergenic (OR > 30) | 858 |
| 11 | 55114405 | 55223056 | 108651 | gain | 1763 | | 49.43 | high OR intergenic (OR > 30) | 859 |
| 11 | 55114405 | 55203706 | 89301 | gain | 1783 | | 49.43 | high OR intergenic (OR > 30) | 857 |
| 11 | 55114405 | 55207305 | 92900 | gain | 1808 | | 49.43 | high OR intergenic (OR > 30) | 850 |
| 11 | 55114405 | 55219985 | 105580 | gain | 1830 | | 49.43 | high OR intergenic (OR > 30) | 851 |
| 11 | 55114405 | 55203706 | 89301 | gain | 1928 | | 49.43 | high OR intergenic (OR > 30) | 857 |
| 11 | 55114405 | 55219985 | 105580 | gain | 2041 | | 49.43 | high OR intergenic (OR > 30) | 851 |
| 11 | 55114405 | 55209626 | 95221 | gain | 2044 | | 49.43 | high OR intergenic (OR > 30) | 858 |
| 11 | 55509638 | 55516797 | 7159 | loss | 1868 | OR7E5P | 2.95 | Exon + ve, 5 > ASD > 1, Normals < 2, Sanger − ve | 791 |
| 11 | 55510238 | 55516120 | 5882 | loss | 1245 | OR7E5P | 2.95 | Exon + ve, 5 > ASD > 1, Normals < 2, Sanger − ve | 790 |
| 11 | 88553783 | 88566456 | 12673 | loss | 1539 | TYR | 8.91 | Intron + ve, ASD > 4, Normals < 2, no Sanger filter applied | 472 |
| 11 | 88560991 | 88562255 | 1264 | loss | 1691 | TYR | 8.91 | Intron + ve, ASD > 4, Normals < 2, no Sanger filter applied | 473 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 11 | 88560991 | 88562255 | 1264 | loss | 1720 | TYR | 8.91 | Intron + ve, ASD > 4, Normals < 2, no Sanger filter applied | 473 |
| 11 | 88560991 | 88562255 | 1264 | loss | 1746 | TYR | 8.91 | Intron + ve, ASD > 4, Normals < 2, no Sanger filter applied | 473 |
| 11 | 88560991 | 88562255 | 1264 | loss | 1760 | TYR | 8.91 | Intron + ve, ASD > 4, Normals < 2, no Sanger filter applied | 473 |
| 11 | 88560991 | 88562255 | 1264 | gain | 1993 | TYR | 8.91 | Intron + ve, ASD > 4, Normals < 2, no Sanger filter applied | 474 |
| 11 | 101496791 | 101499019 | 2228 | loss | 1247 | YAP1 | 8.91 | Genic (distinct CNV-subreaions); OR > 6 | 474 |
| 11 | 101496791 | 101499019 | 2228 | loss | 1274 | YAP1 | 8.91 | Genic (distinct CNV-subreaions); OR > 6 | 474 |
| 11 | 101496791 | 101499019 | 2228 | loss | 1546 | YAP1 | 8.91 | Genic (distinct CNV-subreaions); OR > 6 | 475 |
| 11 | 101544468 | 101550679 | 6211 | gain | 1221 | YAP1 | 8.91 | Genic (distinct CNV-subreaions); OR > 6 | 476 |
| 11 | 101550679 | 101554376 | 3697 | loss | 1233 | YAP1 | 8.91 | Genic (distinct CNV-subreaions); OR > 6 | 476 |
| 11 | 101550679 | 101554376 | 3697 | loss | 2037 | YAP1 | 8.91 | Genic (distinct CNV-subregions); OR > 6 | 476 |
| 11 | 107160270 | 107177546 | 17376 | gain | 1222 | SLC35F2 | 8.91 | Intron + ve, ASD > 4, Normals < 2, no Sanger filter applied | 477 |
| 11 | 107160270 | 107177546 | 17276 | gain | 1349 | SLC35F2 | 8.91 | Intron + ve, ASD > 4, Normals < 2, no Sanger filter applied | 477 |
| 11 | 107160270 | 107177546 | 17276 | gain | 1794 | SLC35F2 | 8.91 | Intron + ve, ASD > 4, Normals < 2, no Sanger filter applied | 477 |
| 11 | 107160270 | 107177516 | 17276 | gain | 1818 | SLC35F2 | 8.91 | Intron + ve, ASD > 4, Normals < 2, no Sanger filter applied | 177 |
| 11 | 107160270 | 107177516 | 17276 | gain | 1860 | SLC35F2 | 8.91 | Intron + ve, ASD > 4, Normals < 2, no Sanger filter applied | 477 |
| 11 | 107160270 | 107177516 | 17276 | gain | 1867 | SLC35F2 | 8.91 | Intron + ve, ASD > 4, Normals < 2, no Sanger filter applied | 477 |
| 11 | 120856405 | 120859352 | 2947 | gain | 1324 | SORL1 | 7.42 | Intron + ve, ASD > 4, Normals < 2, no Sanger filter applied | 590 |
| 11 | 120856405 | 120859352 | 2947 | gain | 1411 | SORL1 | 7.42 | Intron + ve, ASD > 4, Normals < 2, no Sanger filter applied | 590 |
| 11 | 120856405 | 120859352 | 2947 | gain | 1416 | SORL1 | 7.42 | Intron + ve, ASD > 4, Normals < 2, no Sanger filter applied | 590 |
| 11 | 120856405 | 120859352 | 2947 | gain | 1825 | SORL1 | 7.42 | Intron + ve, ASD > 4, Normals < 2, no Sanger filter applied | 590 |
| 11 | 120856405 | 120859352 | 2947 | gain | 1834 | SORL1 | 7.42 | Intron + ve, ASD > 4, Normals < 2, no Sanger filter applied | 590 |
| 11 | 123756697 | 123770639 | 13942 | gain | 1463 | OR8B2 | 2.95 | Exon + ve, 5 > ASD > 1, Normals < 2, Sanger – ve | 792 |
| 11 | 123756697 | 123770639 | 13942 | gain | 1467 | OR8B2 | 2.95 | Exon + ve, 5 > ASD > 1, Normals < 2, Sanger – ve | 792 |
| 11 | 131427991 | 131434659 | 6668 | gain | 1604 | NTM | 8.91 | Intron + ve, ASD > 4, Normals < 2, no Sanger filter applied | 478 |
| 11 | 131427991 | 131436397 | 8406 | gain | 1644 | NTM | 8.91 | Intron + ve, ASD > 4, Normals < 2, no Sanger filter applied | 479 |
| 11 | 131427991 | 131434659 | 6668 | gain | 1660 | NTM | 8.91 | Intron + ve, ASD > 4, Normals < 2, no Sanger filter applied | 478 |
| 11 | 131427991 | 131434659 | 6668 | gain | 1808 | NTM | 8.91 | Intron + ve, ASD > 4, Normals < 2, no Sanger filter applied | 478 |
| 11 | 131427991 | 131436397 | 8406 | gain | 1843 | NTM | 8.91 | Intron + ve, ASD > 4, Normals < 2, no Sanger filter applied | 479 |
| 11 | 131427991 | 131434659 | 6668 | gain | 1912 | NTM | 8.91 | Intron + ve, ASD > 4, Normals < 2, no Sanger filter applied | 478 |
| 12 | 12422129 | 12433043 | 10914 | loss | 1349 | LOH12CR1 | 11.92 | Intron + ve, ASD > 4, Normals < 2, no Sanger filter applied | 370 |
| 12 | 12422129 | 12433043 | 10914 | loss | 1463 | LOH12CR1 | 11.92 | Intron + ve, ASD > 4, Normals < 2, no Sanger filter applied | 370 |
| 12 | 12422129 | 12433043 | 10914 | loss | 1722 | LOH12CR1 | 11.92 | Intron + ve, ASD > 4, Normals < 2, no Sanger filter applied | 370 |
| 12 | 12422129 | 12433043 | 10914 | loss | 1754 | LOH12CR1 | 11.92 | Intron + ve, ASD > 4, Normals < 2, no Sanger filter applied | 370 |
| 12 | 12422129 | 12433043 | 10914 | loss | 1778 | LOH12CR1 | 11.92 | Intron + ve, ASD > 4, Normals < 2, no Sanger filter applied | 370 |
| 12 | 12422129 | 12433043 | 10914 | loss | 1923 | LOH12CR1 | 11.92 | Intron + ve, ASD > 4, Normals < 2, no Sanger filter applied | 370 |
| 12 | 12422129 | 12433043 | 10914 | loss | 1942 | LOH12CR1 | 11.92 | Intron + ve, ASD > 4, Normals < 2, no Sanger filter applied | 370 |
| 12 | 12422129 | 12433043 | 10914 | loss | 2006 | LOH12CR1 | 11.92 | Intron + ve, ASD > 4, Normals < 2, no Sanger filter applied | 370 |
| 12 | 79721736 | 79723181 | 1445 | loss | 1281 | LIN7A | 7.42 | Intron + ve, ASD > 4, Normals < 2, no Sanger filter applied | 591 |
| 12 | 79721736 | 79723181 | 1445 | loss | 1465 | LIN7A | 7.42 | Intron + ve, ASD > 4, Normals < 2, no Sanger filter applied | 591 |
| 12 | 79721736 | 79723181 | 1445 | loss | 1476 | LIN7A | 7.42 | Intron + ve, ASD > 4, Normals < 2, no Sanger filter applied | 591 |
| 12 | 79721736 | 79723181 | 1445 | loss | 1511 | LIN7A | 7.42 | Intron + ve, ASD > 4, Normals < 2, no Sanger filter applied | 591 |
| 12 | 79721736 | 79723181 | 1445 | loss | 1599 | LIN7A | 7.42 | Intron + ve, ASD > 4, Normals < 2, no Sanger filter applied | 591 |
| 12 | 100624427 | 100631726 | 7299 | loss | 1874 | CHPT1 | 13.43 | Intron + ve, ASD > 4, Normals < 2, no Sanger filter applied | 341 |
| 12 | 100626837 | 100631726 | 4889 | loss | 1395 | CHPT1 | 13.43 | Intron + ve, ASD > 4, Normals < 2, no Sanger filter applied | 340 |
| 12 | 100626837 | 100631726 | 4889 | loss | 1422 | CHPT1 | 13.43 | Intron + ve, ASD > 4, Normals < 2, no Sanger filter applied | 340 |
| 12 | 100626837 | 100631726 | 4889 | loss | 1573 | CHPT1 | 13.43 | Intron + ve, ASD > 4, Normals < 2, no Sanger filter applied | 340 |
| 12 | 100626837 | 100631726 | 4889 | loss | 1616 | CHPT1 | 13.43 | Intron + ve, ASD > 4, Normals < 2, no Sanger filter applied | 340 |
| 12 | 100626837 | 100631726 | 4889 | loss | 1621 | CHPT1 | 13.43 | Intron + ve, ASD > 4, Normals < 2, no Sanger filter applied | 340 |
| 12 | 100626837 | 100631726 | 4889 | loss | 1815 | CHPT1 | 13.43 | Intron + ve, ASD > 4, Normals < 2, no Sanger filter applied | 340 |
| 12 | 100626837 | 100631726 | 4889 | loss | 1898 | CHPT1 | 13.43 | Intron + ve, ASD > 4, Normals < 2, no Sanger filter applied | 340 |
| 12 | 100626837 | 100631726 | 4889 | loss | 1900 | CHPT1 | 13.43 | Intron + ve, ASD > 4, Normals < 2, no Sanger filter applied | 340 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 12 | 108123730 | 108127525 | 3795 | gain | 1902 | ACACB | 4.44 | Exon + ve, 5 > ASD > 1, Normals < 2, Sanger − ve | 710 |
| 12 | 108123730 | 108126163 | 2433 | gain | 1936 | ACACB | 4.44 | Exon + ve, 5 > ASD > 1, Normals < 2, Sanger − ve | 711 |
| 12 | 108123730 | 108126163 | 2433 | gain | 1937 | ACACB | 4.44 | Exon + ve, 5 > ASD > 1, Normals < 2, Sanger − ve | 711 |
| 12 | 110497697 | 110512490 | 14793 | loss | 1443 | ATXN2 | 7.42 | Intron + ve, ASD > 4, Normals < 2, no Sanger filter applied | 592 |
| 12 | 110497697 | 110509958 | 12261 | loss | 1576 | ATXN2 | 7.42 | Intron + ve, ASD > 4, Normals < 2, no Sanger filter applied | 593 |
| 12 | 110497697 | 110509958 | 12261 | loss | 1604 | ATXN2 | 7.42 | Intron + ve, ASD > 4, Normals < 2, no Sanger filter applied | 593 |
| 12 | 110497697 | 110509958 | 12261 | loss | 1815 | ATXN2 | 7.42 | Intron + ve, ASD > 4, Normals < 2, no Sanger filter applied | 593 |
| 12 | 110497697 | 110509958 | 12261 | loss | 1854 | ATXN2 | 7.42 | Intron + ve, ASD > 4, Normals < 2, no Sanger filter applied | 593 |
| 12 | 119355352 | 119372494 | 17142 | gain | 1543 | GATC, COX6A1, TRIAP1 | 4.44 | Exon + ve, 5 > ASD > 1, Normals < 2, Sanger − ve | 712 |
| 12 | 119355352 | 119372494 | 17142 | gain | 1599 | GATC, COX6A1, TRIAP1 | 4.44 | Exon + ve, 5 > ASD > 1, Normals < 2, Sanger − ve | 712 |
| 12 | 119355352 | 119372494 | 17142 | gain | 1851 | GATC, COX6A1, TRIAP1 | 4.44 | Exon + ve, 5 > ASD > 1, Normals < 2, Sanger − ve | 712 |
| 12 | 131716981 | 131825117 | 108136 | loss | 1621 | PGAM5 | 2.95 | Exon + ve, 5 > ASD > 1, Normals < 2, Sanger − ve | 794 |
| 12 | 131707099 | 131806639 | 9540 | loss | 1256 | PGAM5 | 2.95 | Exon + ve, 5 > ASD > 1, Normals < 2, Sanger − ve | 793 |
| 13 | 27892889 | 27894406 | 1517 | loss | 1299 | FLT1 | 11.92 | Intron + ve, ASD > 4, Normals < 2, no Sanger filter applied | 371 |
| 13 | 27892889 | 27894406 | 1517 | loss | 1447 | FLT1 | 11.92 | Intron + ve, ASD > 4, Normals < 2, no Sanger filter applied | 371 |
| 13 | 27892889 | 27894406 | 1517 | loss | 1592 | FLT1 | 11.92 | Intron + ve, ASD > 4, Normals < 2, no Sanger filter applied | 371 |
| 13 | 27892880 | 27894406 | 1517 | loss | 1752 | FLT1 | 11.92 | Intron + ve, ASD > 4, Normals < 2, no Sanger filter applied | 371 |
| 13 | 27892889 | 27894406 | 1517 | loss | 1779 | FLT1 | 11.92 | Intron + ve, ASD > 4, Normals < 2, no Sanger filter applied | 371 |
| 13 | 27892889 | 27895569 | 2680 | loss | 1912 | FLT1 | 11.92 | Intron + ve, ASD > 4, Normals < 2, no Sanger filter applied | 372 |
| 13 | 27892889 | 27894406 | 1517 | loss | 1916 | FLT1 | 11.92 | Intron + ve, ASD > 4, Normals < 2, no Sanger filter applied | 371 |
| 13 | 27892889 | 27894406 | 1517 | loss | 1952 | FLT1 | 11.92 | Intron + ve, ASD > 4, Normals < 2, no Sanger filter applied | 371 |
| 13 | 37988946 | 37992035 | 3089 | loss | 1687 | | 33.47 | high OR intergenic (OR > 30) | 876 |
| 13 | 37988946 | 37992035 | 3089 | loss | 1720 | | 33.47 | high OR intergenic (OR > 30) | 876 |
| 13 | 37988946 | 37992035 | 3089 | loss | 1722 | | 33.47 | high OR intergenic (OR > 30) | 876 |
| 13 | 37988946 | 37992035 | 3089 | loss | 1737 | | 33.47 | high OR intergenic (OR > 30) | 876 |
| 13 | 37988946 | 37992035 | 3089 | loss | 1742 | | 33.47 | high OR intergenic (OR > 30) | 876 |
| 13 | 37988946 | 37992035 | 3089 | loss | 1754 | | 33.47 | high OR intergenic (OR > 30) | 876 |
| 13 | 37988946 | 37992035 | 3089 | loss | 1755 | | 33.47 | high OR intergenic (OR > 30) | 876 |
| 13 | 37988946 | 37992035 | 3089 | loss | 1848 | | 33.47 | high OR intergenic (OR > 30) | 876 |
| 13 | 37988946 | 37992035 | 3089 | loss | 1855 | | 33.47 | high OR intergenic (OR > 30) | 876 |
| 13 | 37988946 | 37992035 | 3089 | loss | 1868 | | 33.47 | high OR intergenic (OR > 30) | 876 |
| 13 | 37988946 | 37992035 | 3089 | loss | 1881 | | 33.47 | high OR intergenic (OR > 30) | 876 |
| 13 | 37988946 | 37992035 | 3089 | loss | 1918 | | 33.47 | high OR intergenic (OR > 30) | 876 |
| 13 | 37988946 | 37992035 | 3089 | loss | 1919 | | 33.47 | high OR intergenic (OR > 30) | 876 |
| 13 | 37988946 | 37992035 | 3089 | loss | 1920 | | 33.47 | high OR intergenic (OR > 30) | 876 |
| 13 | 37988946 | 37992035 | 3089 | loss | 1921 | | 33.47 | high OR intergenic (OR > 30) | 876 |
| 13 | 37988946 | 37992035 | 3089 | loss | 1935 | | 33.47 | high OR intergenic (OR > 30) | 876 |
| 13 | 37988946 | 37992035 | 3089 | loss | 1938 | | 33.47 | high OR intergenic (OR > 30) | 876 |
| 13 | 37988946 | 37992035 | 3089 | loss | 1942 | | 33.47 | high OR intergenic (OR > 30) | 876 |
| 13 | 37988946 | 37992035 | 3089 | loss | 1953 | | 33.47 | high OR intergenic (OR > 30) | 876 |
| 13 | 37988946 | 37992035 | 3089 | loss | 1963 | | 33.47 | high OR intergenic (OR > 30) | 876 |
| 13 | 37988946 | 37992035 | 3089 | loss | 1965 | | 33.47 | high OR intergenic (OR > 30) | 876 |
| 13 | 37988946 | 37992035 | 3089 | loss | 1969 | | 33.47 | high OR intergenic (OR > 30) | 876 |
| 13 | 42372718 | 42687363 | 314645 | gain | 1897 | DNAJC15 | 2.95 | Exon + ve, 5 > ASD > 1, Normals < 2, Sanger − ve | 795 |
| 13 | 42372718 | 42687363 | 314645 | gain | 1897 | ENOX1 | 2.95 | Exon + ve, 5 > ASD > 1, Normals < 2, Sanger − ve | 795 |
| 13 | 42507464 | 42607572 | 100108 | gain | 1948 | DNAJC15 | 2.95 | Exon + ve, 5 > ASD > 1, Normals < 2, Sanger − ve | 796 |
| 13 | 42593061 | 42915998 | 322937 | loss | 1316 | ENOX1 | 2.95 | Exon + ve, 5 > ASD > 1, Normals < 2, Sanger − ve | 797 |
| 13 | 45637710 | 45637778 | 68 | loss | 1227 | LCP1 | 38.2 | Intron + ve, ASD > 4, Normals < 2, no Sanger filter applied | 173 |
| 13 | 45637710 | 45637778 | 68 | loss | 1293 | LCP1 | 38.2 | Intron + ve, ASD > 4, Normals < 2, no Sanger Filter applied | 173 |
| 13 | 45637710 | 45637778 | 68 | loss | 1296 | LCP1 | 38.2 | Intron + ve, ASD > 4, Normals < 2, no Sanger filter applied | 173 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 13 | 45637710 | 45637778 | 68 | loss | 1297 | LCP1 | 38.2 | Intron + ve, ASD > 4, Normals < 2, no Sanger filter applied | 173 |
| 13 | 45637710 | 45637778 | 68 | gain | 1402 | LCP1 | 38.2 | Intron + ve, ASD > 4, Normals < 2, no Sanger filter applied | 173 |
| 13 | 45637710 | 45637778 | 68 | loss | 1451 | LCP1 | 38.2 | Intron + ve, ASD > 4, Normals < 2, no Sanger filter applied | 173 |
| 13 | 45637710 | 45637778 | 68 | loss | 1452 | LCP1 | 38.2 | Intron + ve, ASD > 4, Normals < 2, no Sanger filter applied | 173 |
| 13 | 15637710 | 45637778 | 68 | loss | 1657 | LCP1 | 38.2 | Intron + ve, ASD > 4, Normals < 2, no Sanger filter applied | 173 |
| 13 | 45637710 | 45637778 | 68 | loss | 1723 | LCP1 | 38.2 | Intron + ve, ASD > 4, Normals < 2, no Sanger filter applied | 173 |
| 13 | 45637710 | 45637778 | 68 | loss | 1742 | LCP1 | 38.2 | Intron + ve, ASD > 4, Normals < 2, no Sanger filter applied | 173 |
| 13 | 45637710 | 45637778 | 68 | loss | 1761 | LCP1 | 38.2 | Intron + ve, ASD > 4, Normals < 2, no Sanger filter applied | 173 |
| 13 | 45637710 | 45637778 | 68 | loss | 1839 | LCP1 | 38.2 | Intron + ve, ASD > 4, Normals < 2, no Sanger filter applied | 173 |
| 13 | 45637710 | 45637778 | 68 | loss | 1848 | LCP1 | 38.2 | Intron + ve, ASD > 4, Normals < 2, no Sanger filter applied | 173 |
| 13 | 45637710 | 45637778 | 68 | loss | 1871 | LCP1 | 38.2 | Intron + ve, ASD > 4, Normals < 2, no Sanger filter applied | 173 |
| 13 | 15637710 | 45637778 | 68 | loss | 1803 | LCP1 | 38.2 | Intron + ve, ASD > 4, Normals < 2, no Sanger filter applied | 173 |
| 13 | 45637710 | 45637778 | 68 | loss | 1925 | LCP1 | 38.2 | Intron + ve, ASD > 4, Normals < 2, no Sanger filter applied | 173 |
| 13 | 45637710 | 45637778 | 68 | loss | 1927 | LCP1 | 38.2 | Intron + ve, ASD > 4, Normals < 2, no Sanger filter applied | 173 |
| 13 | 45637710 | 45637778 | 68 | loss | 1954 | LCP1 | 38.2 | Intron + ve, ASD > 4, Normals < 2, no Sanger filter applied | 173 |
| 13 | 45637710 | 45637778 | 68 | loss | 1956 | LCP1 | 38.2 | Intron + ve, ASD > 4, Normals < 2, no Sanger filter applied | 173 |
| 13 | 45637710 | 45637778 | 68 | loss | 1958 | LCP1 | 38.2 | Intron + ve, ASD > 4, Normals < 2, no Sanger filter applied | 173 |
| 13 | 45637710 | 45637778 | 68 | loss | 1965 | LCP1 | 38.2 | Intron + ve, ASD > 4, Normals < 2, no Sanger filter applied | 173 |
| 13 | 45637710 | 45637778 | 68 | loss | 1969 | LCP1 | 38.2 | Intron + ve, ASD > 4, Normals < 2, no Sanger filter applied | 173 |
| 13 | 45637710 | 45637778 | 68 | loss | 1970 | LCP1 | 38.2 | Intron + ve, ASD > 4, Normals < 2, no Sanger filter applied | 173 |
| 13 | 45637710 | 45637778 | 68 | loss | 2030 | LCP1 | 38.2 | Intron + ve, ASD > 4, Normals < 2, no Sanger filter applied | 173 |
| 13 | 45637710 | 45637778 | 68 | loss | 2031 | LCP1 | 38.2 | Intron + ve, ASD > 4, Normals < 2, no Sanger filter applied | 173 |
| 13 | 100692746 | 100695073 | 2327 | gain | 1251 | NALCN | 7.42 | Intron + ve, ASD > 4, Normals < 2, no Sanger filter applied | 594 |
| 13 | 100692746 | 100695073 | 2327 | gain | 1272 | NALCN | 7.42 | Intron + ve, ASD > 4, Normals < 2, no Sanger filter applied | 594 |
| 13 | 100692746 | 100695073 | 2327 | gain | 1776 | NALCN | 7.42 | Intron + ve, ASD > 4, Normals < 2, no Sanger filter applied | 594 |
| 13 | 100692746 | 100695073 | 2327 | gain | 1815 | NALCN | 7.42 | Intron + ve, ASD > 4, Normals < 2, no Sanger filter applied | 594 |
| 13 | 100692746 | 100695073 | 2327 | gain | 1883 | NALCN | 7.42 | Intron + ve, ASD > 4, Normals < 2, no Sanger filter applied | 594 |
| 13 | 100923250 | 100931039 | 7789 | gain | 1422 | ITGBL1 | 8.91 | Intron + ve, ASD > 4, Normals < 2, no Sanger filter applied | 480 |
| 13 | 100923250 | 100931179 | 7929 | gain | 1551 | ITGBL1 | 8.91 | Intron + ve, ASD > 4, Normals < 2, no Sanger filter applied | 481 |
| 13 | 100923250 | 100931039 | 7789 | gain | 1742 | ITGBL1 | 8.91 | Intron + ve, ASD > 4, Normals < 2, no Sanger filter applied | 480 |
| 13 | 100923250 | 100931039 | 7789 | gain | 1753 | ITGBL1 | 8.91 | Intron + ve, ASD > 4, Normals < 2, no Sanger filter applied | 480 |
| 13 | 100923250 | 100931039 | 7789 | gain | 1867 | ITGBL1 | 8.91 | Intron + ve, ASD > 4, Normals < 2, no Sanger filter applied | 480 |
| 13 | 100923250 | 100931039 | 7789 | gain | 1881 | ITGBL1 | 8.91 | Intron + ve, ASD > 4, Normals < 2, no Sanger filter applied | 480 |
| 13 | 101217467 | 101229748 | 12281 | gain | 1781 | FGF14 | 8.91 | Genic (distinct CNV-subregions); OR > 6 | 482 |
| 13 | 101217467 | 101229748 | 12281 | gain | 1925 | FGF14 | 8.91 | Genic (distinct CNV-subregions); OR > 6 | 482 |
| 13 | 101524762 | 101598573 | 73811 | loss | 1826 | FGF14 | 8.91 | Genic (distinct CNV-subregions); OR > 6 | 483 |
| 13 | 101524762 | 101598573 | 73811 | loss | 1826 | FGF14 | 8.91 | Genic (distinct CNV-subregions); OR > 6 | 483 |
| 13 | 101521762 | 101508573 | 73811 | loss | 1826 | FGF14 | 8.91 | Genic (distinct CNV-subregions); OR > 6 | 483 |
| 13 | 101524762 | 101598573 | 73811 | loss | 1617 | FGF14 | 8.91 | Genic (distinct CNV-subregions); OR > 6 | 483 |
| 13 | 101574080 | 101575763 | 1683 | loss | 1597 | FGF14 | 8.91 | Genic (distincl CNV-subregions); OR > 6 | 484 |
| 13 | 101582092 | 101587700 | 5608 | loss | 1954 | FGF14 | 8.91 | Genic (distinct CNV-subregions); OR > 6 | 485 |
| 13 | 101641002 | 101646218 | 5216 | gain | 1308 | SLC10A2 | 8.91 | Genic (distinct CNV-subregions); OR > 6 | 486 |
| 13 | 102483043 | 102499472 | 16429 | gain | 1320 | SLC10A2 | 7.42 | Exon + ve, ASD > 4, Normals < 2, no Sanger filter applied | 595 |
| 13 | 102483043 | 102499472 | 16429 | gain | 1521 | SLC10A2 | 7.42 | Exon + ve, ASD > 4, Normals < 2, no Sanger filter applied | 595 |
| 13 | 102199472 | 102199472 | 16429 | gain | 1580 | SLC10A2 | 7.42 | Exon + ve, ASD > 4, Normals < 2, no Sanger filter applied | 595 |
| 13 | 102483043 | 102499472 | 16429 | gain | 1826 | SLC10A2 | 7.42 | Exon + ve, ASD > 4, Normals < 2, no Sanger filter applied | 595 |
| 13 | 102483043 | 102499472 | 16429 | gain | 1954 | SLC10A2 | 7.42 | Exon + ve, ASD > 4, Normals < 2, no Sanger filter applied | 595 |
| 13 | 112711763 | 112829665 | 117902 | gain | 1471 | MCF2L | 2.95 | Exon + ve, 5 > ASD > 1, Normals < 2, Sanger − ve | 799 |
| 13 | 112793058 | 112805778 | 12720 | gain | 1418 | MCF2L | 2.95 | Exon + ve, 5 > ASD > 1, Normals < 2, Sanger − ve | 798 |
| 13 | 113762090 | 113767184 | 5094 | loss | 1956 | RASA3 | 2.95 | Exon + ve, 5 > ASD > 1, Normals < 2, Sanger − ve | 800 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 13 | 113762090 | 113767184 | 5094 | loss | 1958 | RASA3 | 2.95 | Exon + ve, 5 > ASD > 1, Normals < 2, Sanger – ve | 800 |
| 14 | 22929952 | 22958797 | 28845 | loss | 1537 | MYH6 | 4.44 | Exon + ve, 5 > ASD > 1, Normals < 2, Sanger – ve | 596 |
| 14 | 22929952 | 22959169 | 29517 | loss | 1669 | MYH6 | 4.44 | Exon + ve, 5 > ASD > 1, Normals < 2, Sanger – ve | 598 |
| 14 | 22929952 | 22957582 | 27630 | gain | 1945 | MYH6 | 4.44 | Exon + ve, 5 > ASD > 1, Normals < 2, Sanger – ve | 600 |
| 14 | 22929952 | 22958797 | 28845 | loss | 1537 | MYH6 | 7.42 | Exon + ve, ASD > 4, Normals < 2, no Sanger filter applied | 596 |
| 14 | 22929952 | 22959469 | 29517 | loss | 1669 | MYH6 | 7.42 | Exon + ve, ASD > 4, Normals < 2, no Sanger filter applied | 598 |
| 14 | 32929952 | 22957582 | 27630 | gain | 1945 | MYH6 | 7.42 | Exon + ve, ASD > 4, Normals < 2, no Sanger filter applied | 600 |
| 14 | 22929952 | 22959469 | 29517 | loss | 1669 | MYH6 | 7.42 | Exon + ve, ASD > 4, Normals < 2, no Sanger filter applied | 598 |
| 14 | 22929952 | 22958797 | 28845 | loss | 1537 | MYH7 | 7.42 | Exon + ve, ASD > 4, Normals < 2, no Sanger filter applied | 596 |
| 14 | 22929952 | 23959469 | 29517 | loss | 1669 | MYH7 | 7.42 | Exon + ve, ASD > 4, Normals < 2, no Sanger filter applied | 598 |
| 14 | 22929952 | 22957582 | 27630 | gain | 1915 | MYH7 | 7.42 | Exon + ve, ASD > 4, Normals < 2, no Sanger filter applied | 600 |
| 14 | 22929952 | 22958797 | 28845 | loss | 1537 | MIR208B, MYH7 | 4.44 | Exon + ve, 5 > ASD > 1, Normals < 2, Sanger – ve | 596 |
| 14 | 22929952 | 22959469 | 29517 | loss | 1669 | MIR208B, MYH7 | 4.44 | Exon + ve, 5 > ASD > 1, Normals < 2, Sanger – ve | 598 |
| 14 | 22929952 | 22957582 | 27630 | gain | 1945 | MIR208B, MYH7 | 4.44 | Exon + ve, 5 > ASD > 1, Normals < 2, Sanger – ve | 600 |
| 14 | 22929952 | 22958797 | 28845 | loss | 1537 | MYH7 | 2.95 | Exon + ve, 5 > ASD > 1, Normals < 2, Sanger – ve | 596 |
| 14 | 22929952 | 22959469 | 29517 | loss | 1669 | MYH7 | 2.95 | Exon + ve, 5 > ASD > 1, Normals < 2, Sanger – ve | 598 |
| 14 | 22943262 | 22951086 | 7824 | loss | 1577 | MYH6 | 7.42 | Exon + ve, ASD > 4, Normals < 2, no Sanger filter applied | 597 |
| 14 | 22943262 | 22955470 | 12208 | loss | 1856 | MYH6 | 7.42 | Exon + ve, ASD > 4, Normals < 2, no Sanger filter applied | 599 |
| 14 | 22943262 | 22955470 | 12208 | loss | 1856 | MYH7 | 7.42 | Exon + ve, ASD > 4, Normals < 2, no Sanger filter applied | 599 |
| 14 | 22946615 | 22955470 | 8855 | loss | 2032 | MYH7 | 7.42 | Exon + ve, ASD > 4, Normals < 2, no Sanger filter applied | 601 |
| 14 | 38866449 | 38872944 | 6495 | loss | 1235 | CTAGE5 | 11.92 | Intron + ve, ASD > 4, Normals < 2, no Sanger filter applied | 373 |
| 14 | 38866449 | 38872818 | 6369 | loss | 1237 | CTAGE5 | 11.92 | Intron + ve, ASD > 4, Normals < 2, no Sanger filter applied | 374 |
| 14 | 38866449 | 38872944 | 6495 | loss | 1526 | CTAGE5 | 11.92 | Intron + ve, ASD > 4, Normals < 2, no Sanger filter applied | 373 |
| 14 | 38866449 | 38874484 | 8035 | loss | 1541 | CTAGE5 | 11.92 | Intron + ve, ASD > 4, Normals < 2, no Sanger filter applied | 375 |
| 14 | 38866449 | 38874484 | 8035 | loss | 1609 | CTAGE5 | 11.92 | Intron + ve, ASD > 4, Normals < 2, no Sanger filter applied | 375 |
| 14 | 38866449 | 38872944 | 6495 | loss | 1819 | CTAGE5 | 11.92 | Intron + ve, ASD > 4, Normals < 2, no Sanger filter applied | 373 |
| 14 | 38866449 | 38872818 | 6369 | loss | 1915 | CTAGE5 | 11.92 | Intron + ve, ASD > 4, Normals < 2, no Sanger filter applied | 374 |
| 14 | 38866449 | 38872944 | 6495 | loss | 2027 | CTAGE5 | 11.92 | Intron + ve, ASD > 4, Normals < 2, no Sanger filter applied | 373 |
| 14 | 38866449 | 38872944 | 6495 | loss | 1235 | CTAGE5 | 8.91 | Intron + ve, ASD > 4, Normals < 2, no Sanger filter applied | 373 |
| 14 | 38866449 | 38872944 | 6495 | loss | 1526 | CTAGE5 | 8.91 | Intron + ve, ASD > 4, Normals < 2, no Sanger filter applied | 373 |
| 14 | 38866449 | 38874484 | 8035 | loss | 1541 | CTAGE5 | 8.91 | Intron + ve, ASD > 4, Normals < 2, no Sanger filter applied | 375 |
| 14 | 38866449 | 38874484 | 8035 | loss | 1609 | CTAGE5 | 8.91 | Intron + ve, ASD > 4, Normals < 2, no Sanger filter applied | 375 |
| 14 | 38866449 | 38872944 | 6495 | loss | 1819 | CTAGE5 | 8.91 | Intron + ve, ASD > 4, Normals < 2, no Sanger filter applied | 373 |
| 14 | 38866449 | 38872944 | 6495 | loss | 2027 | CTAGE5 | 8.91 | Intron + ve, ASD > 4, Normals < 2, no Sanger filter applied | 373 |
| 14 | 46772100 | 46787389 | 15289 | loss | 1729 | MDGA2 | 7.42 | Intron + ve, ASD > 4, Normals < 2, no Sanger filter applied | 604 |
| 14 | 46774115 | 46787389 | 13274 | loss | 1609 | MDGA2 | 8.91 | Intron + ve, ASD > 4, Normals < 2, no Sanger filter applied | 602 |
| 14 | 46774115 | 46789074 | 14959 | loss | 1666 | MDGA2 | 7.42 | Intron + ve, ASD > 4, Normals < 2, no Sanger filter applied | 603 |
| 14 | 46774115 | 46787389 | 13274 | loss | 1693 | MDGA2 | 7.42 | Intron + ve, ASD > 4, Normals < 2, no Sanger filter applied | 602 |
| 14 | 46774115 | 46787389 | 13274 | loss | 1850 | MDGA2 | 7.42 | Intron + ve, ASD > 4, Normals < 2, no Sanger filter applied | 602 |
| 14 | 69086125 | 69093444 | 7319 | loss | 1848 |  | 33.47 | high OR intergenic (OR > 30) | 878 |
| 14 | 69086125 | 69093444 | 7319 | loss | 1855 |  | 33.47 | high OR intergenic (OR > 30) | 878 |
| 14 | 69088190 | 69093444 | 5254 | loss | 1401 |  | 33.47 | high OR intergenic (OR > 30) | 877 |
| 14 | 69088190 | 69093444 | 5254 | loss | 1465 |  | 33.47 | high OR intergenic (OR > 30) | 877 |
| 14 | 69088190 | 69093444 | 5254 | loss | 1704 |  | 33.47 | high OR intergenic (OR > 30) | 877 |
| 14 | 69088190 | 69093444 | 5254 | loss | 1710 |  | 33.47 | high OR intergenic (OR > 30) | 877 |
| 14 | 69088190 | 69093444 | 5254 | loss | 1722 |  | 33.47 | high OR intergenic (OR > 30) | 877 |
| 14 | 69088190 | 69093444 | 5254 | loss | 1723 |  | 33.47 | high OR intergenic (OR > 30) | 877 |
| 14 | 69088190 | 69093444 | 5254 | loss | 1751 |  | 33.47 | high OR intergenic (OR > 30) | 877 |
| 14 | 69088190 | 69093444 | 5254 | loss | 1752 |  | 33.47 | high OR intergenic (OR > 30) | 877 |
| 14 | 69088190 | 69093444 | 5254 | loss | 1754 |  | 33.47 | high OR intergenic (OR > 30) | 877 |
| 14 | 69088190 | 69093444 | 5254 | loss | 1761 |  | 33.47 | high OR intergenic (OR > 30) | 877 |
| 14 | 69088190 | 69093444 | 5254 | loss | 1763 |  | 33.47 | high OR intergenic (OR > 30) | 877 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 14 | 69088190 | 69093141 | 5254 | loss | 1775 | | 33.47 | high OR intergenic (OR > 30) | 877 |
| 14 | 69088190 | 69093444 | 5254 | loss | 1797 | | 33.47 | high OR intergenic (OR > 30) | 877 |
| 14 | 69088190 | 69093444 | 5254 | loss | 1814 | | 33.47 | high OR intergenic (OR > 30) | 877 |
| 14 | 69088190 | 69093444 | 5254 | loss | 1833 | | 33.47 | high OR intergenic (OR > 30) | 877 |
| 14 | 69088190 | 69093444 | 5254 | loss | 1852 | | 33.47 | high OR intergenic (OR > 30) | 877 |
| 14 | 69088190 | 69093444 | 5254 | loss | 1853 | | 33.47 | high OR intergenic (OR > 30) | 877 |
| 14 | 69088190 | 69093444 | 5254 | loss | 1881 | | 33.47 | high OR intergenic (OR > 30) | 877 |
| 14 | 69088190 | 69093444 | 5254 | loss | 1807 | | 33.47 | high OR intergenic (OR > 30) | 877 |
| 14 | 69088190 | 69093144 | 5254 | loss | 1945 | | 33.47 | high OR intergenic (OR > 30) | 877 |
| 14 | 69088190 | 69098569 | 10379 | loss | 1945 | | 33.47 | high OR intergenic (OR > 30) | 879 |
| 14 | 72995201 | 73092112 | 96911 | gain | 1291 | HEATR4 | 22.58 | Intron + ve, ASD > 4, Normals < 2, no Sanger filter applied | 136 |
| 14 | 72995201 | 73092112 | 96911 | gain | 1291 | HEATR4 | 41.39 | Intron + ve, ASD > 4, Normals < 2, no Sanger filter applied | 136 |
| 14 | 73051686 | 73071404 | 19718 | loss | 1237 | HEATR4 | 22.58 | Intron + ve, ASD > 4, Normals < 2, no Sanger filter applied | 134 |
| 14 | 73051686 | 73071404 | 19718 | loss | 1237 | HEATR4 | 41.39 | Intron + ve, ASD > 4, Normals < 2, no Sanger filter applied | 134 |
| 14 | 73058103 | 73061942 | 3839 | loss | 1676 | HEATR4 | 22.58 | Intron + ve, ASD > 4, Normals < 2, no Sanger filter applied | 233 |
| 14 | 73058103 | 73071404 | 13301 | loss | 1687 | HEATR4 | 22.58 | Intron + ve, ASD > 4, Normals < 2, no Sanger filter applied | 139 |
| 14 | 73058103 | 73112042 | 53939 | loss | 1718 | HEATR4 | 22.58 | Intron + ve, ASD > 4, Normals < 2, no Sanger filter applied | 140 |
| 14 | 73058103 | 73092112 | 34009 | loss | 1721 | HEATR4 | 22.58 | Intron + ve, ASD > 4, Normals < 2, no Sanger filter applied | 141 |
| 14 | 73058103 | 73071404 | 13301 | loss | 1687 | HEATR4 | 41.39 | Intron + ve, ASD > 4, Normals < 2, no Sanger filter applied | 139 |
| 14 | 73058103 | 73112042 | 53939 | loss | 1718 | HEATR4 | 41.39 | Intron + ve, ASD > 4, Normals < 2, no Sanger filter applied | 140 |
| 14 | 73058103 | 73092112 | 34009 | loss | 1721 | HEATR4 | 41.39 | Intron + ve, ASD > 4, Normals < 2, no Sanger filter applied | 141 |
| 14 | 73060301 | 73112042 | 51741 | loss | 1238 | HEATR4 | 22.58 | Intron + ve, ASD > 4, Normals < 2, no Sanger filter applied | 135 |
| 14 | 73060301 | 73101327 | 41026 | loss | 1574 | HEATR4 | 41.39 | Intron + ve, ASD > 4, Normals < 2, no Sanger filter applied | 137 |
| 14 | 73060301 | 73092112 | 31811 | loss | 1672 | HEATR4 | 22.58 | Intron + ve, ASD > 4, Normals < 2, no Sanger filter applied | 138 |
| 14 | 73060301 | 73092112 | 31811 | loss | 1720 | HEATR4 | 22.58 | Intron + ve, ASD > 4, Normals < 2, no Sanger filter applied | 138 |
| 14 | 73060301 | 73112042 | 51741 | loss | 1723 | HEATR4 | 22.58 | Intron + ve, ASD > 4, Normals < 2, no Sanger filter applied | 135 |
| 14 | 73060301 | 73092112 | 31811 | loss | 1760 | HEATR4 | 22.58 | Intron + ve, ASD > 4, Normals < 2, no Sanger filter applied | 138 |
| 14 | 73060301 | 73104540 | 44239 | loss | 1862 | HEATR4 | 22.58 | Intron + ve, ASD > 4, Normals < 2, no Sanger filter applied | 144 |
| 14 | 73060301 | 73092112 | 31811 | loss | 1916 | HEATR4 | 22.58 | Intron + ve, ASD > 4, Normals < 2, no Sanger filter applied | 138 |
| 14 | 73060301 | 73112042 | 51741 | loss | 2003 | HEATR4 | 22.58 | Intron + ve, ASD > 4, Normals < 2, no Sanger filter applied | 135 |
| 14 | 73060301 | 73112042 | 51741 | loss | 1238 | HEATR4 | 41.39 | Intron + ve, ASD > 4, Normals < 2, no Sanger filter applied | 135 |
| 14 | 73060301 | 73101327 | 41026 | loss | 1574 | HEATR4 | 41.39 | Intron + ve, ASD > 4, Normals < 2, no Sanger filter applied | 137 |
| 14 | 73060301 | 73092112 | 31811 | loss | 1672 | HEATR4 | 41.39 | Intron + ve, ASD > 4, Normals < 2, no Sanger filter applied | 138 |
| 14 | 73060301 | 73092112 | 31811 | loss | 1720 | HEATR4 | 41.39 | Intron + ve, ASD > 4, Normals < 2, no Sanger filter applied | 138 |
| 14 | 73060301 | 73112042 | 51741 | loss | 1723 | HEATR4 | 41.39 | Intron + ve, ASD > 4, Normals < 2, no Sanger filter applied | 135 |
| 14 | 73060301 | 73092112 | 31811 | loss | 1760 | HEATR4 | 41.39 | Intron + ve, ASD > 4, Normals < 2, no Sanger filter applied | 138 |
| 14 | 73060301 | 73104540 | 44239 | loss | 1862 | HEATR4 | 41.39 | Intron + ve, ASD > 4, Normals < 2, no Sanger filter applied | 144 |
| 14 | 73060301 | 73092112 | 31811 | loss | 1916 | HEATR4 | 41.39 | Intron + ve, ASD > 4, Normals < 2, no Sanger filter applied | 138 |
| 14 | 73060301 | 73112042 | 51741 | loss | 2003 | HEATR4 | 41.39 | Intron + ve, ASD > 4, Normals < 2, no Sanger filter applied | 135 |
| 14 | 73061942 | 73101327 | 39385 | loss | 1232 | HEATR4 | 41.39 | Intron + ve, ASD > 4, Normals < 2, no Sanger filter applied | 132 |
| 14 | 73061942 | 73071404 | 9462 | loss | 1233 | HEATR4 | 41.39 | Intron + ve, ASD > 4, Normals < 2, no Sanger filter applied | 133 |
| 14 | 73061942 | 73092112 | 30170 | loss | 1773 | HEATR4 | 41.39 | Intron + ve, ASD > 4, Normals < 2, no Sanger filter applied | 142 |
| 14 | 73061942 | 73112042 | 50100 | loss | 1779 | HEATR4 | 41.39 | Intron + ve, ASD > 4, Normals < 2, no Sanger filter applied | 113 |
| 14 | 73061942 | 73092112 | 30170 | loss | 1800 | HEATR4 | 41.39 | Intron + ve, ASD > 4, Normals < 2, no Sanger filter applied | 142 |
| 14 | 73061942 | 73112042 | 50100 | loss | 1837 | HEATR4 | 41.39 | Intron + ve, ASD > 4, Normals < 2, no Sanger filter applied | 143 |
| 14 | 73061942 | 73092112 | 30170 | loss | 1871 | HEATR4 | 41.39 | Intron + ve, ASD > 4, Normals < 2, no Sanger filter applied | 142 |
| 14 | 73061942 | 73112042 | 50100 | loss | 1917 | HEATR4 | 41.39 | Intron + ve, ASD > 4, Normals < 2, no Sanger filter applied | 143 |
| 14 | 73061942 | 73092112 | 30170 | loss | 1943 | HEATR4 | 41.39 | Intron + ve, ASD > 4, Normals < 2, no Sanger filter applied | 142 |
| 14 | 73061942 | 73112042 | 50100 | loss | 1948 | HEATR4 | 41.39 | Intron + ve, ASD > 4, Normals < 2, no Sanger filter applied | 143 |
| 14 | 73061942 | 73092112 | 30170 | loss | 1967 | HEATR4 | 41.39 | Intron + ve, ASD > 4, Normals < 2, no Sanger filter applied | 142 |
| 14 | 73061942 | 73002112 | 30170 | loss | 2005 | HEATR4 | 41.39 | Intron + ve, ASD > 4, Normals < 2, no Sanger filter applied | 112 |
| 14 | 73061942 | 73104540 | 42598 | loss | 2041 | HEATR4 | 41.39 | Intron + ve, ASD > 4, Normals < 2, no Sanger filter applied | 145 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 14 | 80413494 | 80429808 | 16314 | loss | 1293 | C14orf145 | 8.91 | Intron + ve, ASD > 4, Normals < 2, no Sanger filter applied | 487 |
| 14 | 80413494 | 80429808 | 16314 | gain | 1324 | C14orf145 | 8.91 | Intron + ve, ASD > 4, Normals < 2, no Sanger filter applied | 487 |
| 14 | 80413494 | 80429808 | 16314 | loss | 1844 | C14orf145 | 8.91 | Intron + ve, ASD > 4, Normals < 2, no Sanger filter applied | 487 |
| 14 | 80413494 | 80429808 | 16314 | loss | 1916 | C14orf145 | 8.91 | Intron + ve, ASD > 4, Normals < 2, no Sanger filter applied | 187 |
| 14 | 80413494 | 80429808 | 16314 | loss | 1957 | C14orf145 | 8.91 | Intron + ve, ASD > 4, Normals < 2, no Sanger filter applied | 487 |
| 14 | 80413494 | 80429808 | 16314 | loss | 1961 | C14orf145 | 8.91 | Intron + ve, ASD > 4, Normals < 2, no Sanger filter applied | 487 |
| 14 | 90323329 | 90324691 | 1365 | loss | 1279 | TTC7B | 11.92 | Intron + ve, ASD > 4, Normals < 2, no Sanger filter applied | 376 |
| 14 | 90323329 | 90324694 | 1365 | loss | 1287 | TTC7B | 11.92 | Intron + ve, ASD > 4, Normals < 2, no Sanger filter applied | 376 |
| 14 | 90323329 | 90324694 | 1365 | gain | 1298 | TTC7B | 11.92 | Intron + ve, ASD > 4, Normals < 2, no Sanger filter applied | 376 |
| 14 | 90323329 | 90321601 | 1365 | loss | 1559 | TTC7B | 11.92 | Intron + ve, ASD > 4, Normals < 2, no Sanger filter applied | 376 |
| 14 | 90323329 | 90324694 | 1365 | loss | 1647 | TTC7B | 11.92 | Intron + ve, ASD > 4, Normals < 2, no Sanger filter applied | 376 |
| 14 | 90323329 | 90324694 | 1365 | loss | 1786 | TTC7B | 11.92 | Intron + ve, ASD > 4, Normals < 2, no Sanger filter applied | 376 |
| 14 | 90323329 | 90324694 | 1365 | loss | 1794 | TTC7B | 11.92 | Intron + ve, ASD > 4, Normals < 2, no Sanger filter applied | 376 |
| 14 | 90323329 | 90324694 | 1365 | loss | 1891 | TTC7B | 11.92 | Intron + ve, ASD > 4, Normals < 2, no Sanger filter applied | 376 |
| 14 | 102008576 | 105330913 | 3322337 | gain | 1447 | JAG2 | 4.44 | Exon + ve, 5 > ASD > 1, Normals < 2, Sanger − ve | 649 |
| 14 | 102008576 | 105330913 | 3322337 | gain | 1447 | JAG2 | 5.92 | Exon + ve, 5 > ASD > 1, Normals < 2, Sanger − ve | 649 |
| 14 | 102008576 | 105330913 | 3322337 | gain | 1447 | PACS2 | 2.95 | Exon + ve, 5 > ASD > 1, Normals < 2, Sanger − ve | 649 |
| 14 | 104679956 | 104715063 | 35107 | loss | 1695 | JAG2 | 4.44 | Exon + ve, 5 > ASD > 1, Normals < 2, Sanger − ve | 650 |
| 14 | 104679956 | 104716526 | 36570 | loss | 1739 | JAG2 | 4.44 | Exon + ve, 5 > ASD > 1, Normals < 2, Sanger − ve | 651 |
| 14 | 104679956 | 104715063 | 35107 | loss | 1695 | JAG2 | 5.92 | Exon + ve, 5 > ASD > 1, Normals < 2, Sanger − ve | 650 |
| 14 | 104679956 | 104716526 | 36570 | loss | 1739 | JAG2 | 5.92 | Exon + ve, 5 > ASD > 1, Normals < 2, Sanger − ve | 651 |
| 14 | 104686613 | 104703676 | 17063 | loss | 1856 | JAG2 | 5.92 | Exon + ve, 5 > ASD > 1, Normals < 2, Sanger − ve | 652 |
| 14 | 104902380 | 104905434 | 3054 | loss | 2036 | PACS2 | 2.95 | Exon + ve, 5 > ASD > 1, Normals < 2, Sanger − ve | 801 |
| 15 | 18362555 | 21246527 | 2883972 | gain | 1333 | GOLGA8E, GOLGA8IP, HERC2P2, HERC2P7 | 10.41 | Exon + ve, ASD > 4, Normals < 2, no Sanger filter applied | 415 |
| 15 | 20742114 | 21218231 | 475790 | gain | 1951 | GOLGA8E, GOLGA8IP, HERC2P2, HERC2P7 | 10.41 | Exon + ve, ASD > 4, Normals < 2, no Sanger filter applied | 417 |
| 15 | 20760283 | 21218234 | 457951 | loss | 1564 | GOLGA8E, GOLGA8IP, HERC2P2, HERC2P7 | 10.41 | Exon + ve, ASD > 4, Normals < 2, no Sanger filter applied | 416 |
| 15 | 20760283 | 21218234 | 457951 | loss | 1761 | GOLGA8E, GOLGA8IP, HERC2P2, HERC2P7 | 10.41 | Exon + ve, ASD > 4, Normals < 2, no Sanger filter applied | 416 |
| 15 | 20760283 | 21218234 | 457951 | loss | 1799 | GOLGA8E, GOLGA8IP, HERC2P2, HERC2P7 | 10.41 | Exon + ve, ASD > 4, Normals < 2, no Sanger filter applied | 416 |
| 15 | 20760283 | 21218234 | 457951 | loss | 1839 | GOLGA8E, GOLGA8IP, HERC2P2, HERC2P7 | 10.41 | Exon + ve, ASD > 4, Normals < 2, no Sanger filter applied | 416 |
| 15 | 20760283 | 21218234 | 457951 | loss | 1948 | GOLGA8E, GOLGA8IP, HERC2P2, HERC2P7 | 10.41 | Exon + ve, ASD > 4, Normals < 2, no Sanger filter applied | 416 |
| 15 | 26805834 | 28439781 | 1633947 | gain | 1988 | APBA2 | 2.95 | Exon + ve, 5 > ASD > 1, Normals < 2, Sanger − ve | 802 |
| 15 | 26805834 | 28154955 | 1349121 | loss | 1994 | APBA2 | 2.95 | Exon + ve, 5 > ASD > 1, Normals < 2, Sanger − ve | 803 |
| 15 | 32445353 | 32594200 | 148847 | loss | 1935 | MIR1233-1, GOLGA8A, MIR1233-2 | 13.43 | Exon + ve, ASD > 4, Normals < 2, no Sanger filter applied | 345 |
| 15 | 32452971 | 32517839 | 64868 | loss | 1245 | MIR1233-1, GOLGA8A, MIR1233-2 | 13.43 | Exon + ve, ASD > 4, Normals < 2, no Sanger filter applied | 342 |
| 15 | 32454294 | 32594200 | 139906 | loss | 1317 | MIR1233-1, GOLGA8A, MIR1233-2 | 13.43 | Exon + ve, ASD > 4, Normals < 2, no Sanger filter applied | 343 |
| 15 | 32454294 | 32594200 | 139906 | loss | 1440 | MIR1233-1, GOLGA8A, MIR1233-2 | 13.43 | Exon + ve, ASD > 4, Normals < 2, no Sanger filter applied | 343 |
| 15 | 32454294 | 32594200 | 139906 | loss | 1724 | MIR1233-1, GOLGA8A, MIR1233-2 | 13.43 | Exon + ve, ASD > 4, Normals < 2, no Sanger filter applied | 343 |
| 15 | 32454294 | 32594200 | 139906 | loss | 2041 | MIR1233-1, GOLGA8A, MIR1233-2 | 13.43 | Exon + ve, ASD > 4, Normals < 2, no Sanger filter applied | 343 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 15 | 32456500 | 32594200 | 137700 | loss | 1449 | MIR1233-1, GOLGA8A, MIR1233-2 | 13.43 | Exon + ve, ASD > 4, Normals < 2, no Sanger filter applied | 344 |
| 15 | 32456500 | 32594200 | 137700 | loss | 1467 | MIR1233-1, GOLGA8A, MIR1233-2 | 13.43 | Exon + ve, ASD > 4, Normals < 2, no Sanger filter applied | 344 |
| 15 | 32456500 | 32594200 | 137700 | loss | 1829 | MIR1233-1, GOLGA8A, MIR1233-2 | 13.43 | Exon + ve, ASD > 4, Normals < 2, no Sanger filter applied | 344 |
| 15 | 52519074 | 52533227 | 14153 | loss | 1260 | UNC13C | 7.42 | Intron + ve, ASD > 4, Normals < 2, no Sanger filter applied | 605 |
| 15 | 52519074 | 52533227 | 14153 | loss | 1451 | UNC13C | 7.42 | Intron + ve, ASD > 4, Normals < 2, no Sanger filter applied | 605 |
| 15 | 52519074 | 52533227 | 14153 | loss | 1670 | UNC13C | 7.42 | Intron + ve, ASD > 4, Normals < 2, no Sanger filter applied | 605 |
| 15 | 52519074 | 52533227 | 14153 | loss | 1672 | UNC13C | 7.42 | Intron + ve, ASD > 4, Normals < 2, no Sanger filter applied | 605 |
| 15 | 52519074 | 52533227 | 14153 | loss | 1741 | UNC13C | 7/42 | Intron + ve, ASD > 4, Normals < 2, no Sanger filter applied | 605 |
| 15 | 56031543 | 56044966 | 13423 | loss | 1680 | ALDH1A2 | 13.43 | Intron + ve, ASD > 4, Normals < 2, no Sanger filter applied | 347 |
| 15 | 56036057 | 56039530 | 3473 | loss | 1233 | ALDH1A2 | 13.43 | Intron + ve, ASD > 4, Normals < 2, no Sanger filter applied | 346 |
| 15 | 56036057 | 56039530 | 3473 | loss | 1371 | ALDH1A2 | 13.43 | Intron + ve, ASD > 4, Normals < 2, no Sanger filter applied | 346 |
| 15 | 56036057 | 56039530 | 3473 | loss | 1402 | ALDH1A2 | 13.43 | Intron + ve, ASD > 4, Normals < 2, no Sanger filter applied | 346 |
| 15 | 56036057 | 56039530 | 3473 | loss | 1407 | ALDH1A2 | 13.43 | Intron + ve, ASD > 4, Normals < 2, no Sanger filter applied | 346 |
| 15 | 56036057 | 56039530 | 3473 | loss | 1464 | ALDH1A2 | 13.43 | Intron + ve, ASD > 4, Normals < 2, no Sanger filter applied | 346 |
| 15 | 56036057 | 56039530 | 3473 | loss | 1519 | ALDH1A2 | 13.43 | Intron + ve, ASD > 4, Normals < 2, no Sanger filter applied | 346 |
| 15 | 56036057 | 56039530 | 3473 | loss | 1602 | ALDH1A2 | 13.43 | Intron + ve, ASD > 4, Normals < 2, no Sanger filter applied | 346 |
| 15 | 56036057 | 56039530 | 3473 | loss | 1902 | ALDH1A2 | 13.43 | Intron + ve, ASD > 4, Normals < 2, no Sanger filter applied | 346 |
| 15 | 69017805 | 69224833 | 207028 | gain | 1565 | LRRC49 | 11.92 | Intron + ve, ASD > 4, Normals < 2, no Sanger filter applied | 378 |
| 15 | 69027858 | 69034501 | 6643 | loss | 1308 | LRRC49 | 11.92 | Intron + ve, ASD > 4, Normals < 2, no Sanger filter applied | 377 |
| 15 | 69027858 | 69034501 | 6643 | loss | 1309 | LRRC49 | 11.92 | Intron + ve, ASD > 4, Normals < 2, no Sanger filter applied | 377 |
| 15 | 69027858 | 69034501 | 6643 | loss | 1420 | LRRC49 | 11.92 | Intron + ve, ASD > 4, Normals < 2, no Sanger filter applied | 377 |
| 15 | 69027858 | 69034501 | 6643 | loss | 1422 | LRRC49 | 11.92 | Intron + ve, ASD > 4, Normals < 2, no Sanger filter applied | 377 |
| 15 | 69027858 | 69034501 | 6643 | loss | 1432 | LRRC49 | 11.92 | Intron + ve, ASD > 4, Normals < 2, no Sanger filter applied | 377 |
| 15 | 69027858 | 69034501 | 6643 | loss | 1434 | LRRC49 | 11.92 | Intron + ve, ASD > 4, Normals < 2, no Sanger filter applied | 377 |
| 15 | 69027858 | 69034501 | 6643 | loss | 1447 | LRRC49 | 11.92 | Intron + ve, ASD > 4, Normals < 2, no Sanger filter applied | 377 |
| 15 | 69592364 | 73892403 | 4300039 | loss | 1415 | SNUPN | 4.44 | Exon + ve, 5 > ASD > 1, Normals > 1, Sanger – ve | 713 |
| 15 | 69592364 | 73892403 | 4300039 | loss | 1415 | SNUPN | 2.95 | Exon + ve, 5 > ASD > 1, Normals > 1, Sanger – ve | 713 |
| 15 | 69592364 | 73892403 | 4300039 | loss | 1415 | SNX33, CSPG4 | 2.95 | Exon + ve, 5 > ASD > 1, Normals > 1, Sanger – ve | 713 |
| 15 | 73661881 | 73759785 | 97904 | gain | 2018 | SNUPN | 4.44 | Exon + ve, 5 > ASD > 1, Normals > 1, Sanger – ve | 715 |
| 15 | 73661881 | 73759785 | 97904 | gain | 2018 | SNUPN | 2.95 | Exon + ve, 5 > ASD > 1, Normals > 1, Sanger – ve | 715 |
| 15 | 73661881 | 73759785 | 97904 | gain | 2018 | SNX33, CSPG4 | 2.95 | Exon + ve, 5 > ASD > 1, Normals > 1, Sanger – ve | 715 |
| 15 | 73680498 | 73686655 | 6157 | loss | 1773 | CIB2 | 4.44 | Exon + ve, 5 > ASD > 1, Normals > 1, Sanger – ve | 714 |
| 15 | 76203086 | 76226426 | 23340 | gain | 1300 | CIB2 | 2.95 | Exon + ve, 5 > ASD > 1, Normals > 1, Sanger – ve | 804 |
| 15 | 76206143 | 76223381 | 17238 | gain | 1918 | CIB2 | 2.95 | Exon + ve, 5 > ASD > 1, Normals > 1, Sanger – ve | 805 |
| 15 | 99826818 | 100282819 | 456001 | gain | 1370 | TM2D3, TARSL2 | 4.44 | Exon + ve, 5 > ASD > 1, Normals > 1, Sanger – ve | 716 |
| 15 | 99845964 | 100128118 | 282154 | gain | 1947 | TM2D3, TARSL2 | 4.44 | Exon + ve, 5 > ASD > 1, Normals > 1, Sanger – ve | 718 |
| 15 | 99976057 | 100071959 | 95902 | gain | 1907 | TM2D3, TARSL2 | 4.44 | Exon + ve, 5 > ASD > 1, Normals > 1, Sanger – ve | 717 |
| 16 | 386962 | 388480 | 1518 | loss | 1248 | NME4 | 5.92 | Exon + ve, 5 > ASD > 1, Normals > 1, Sanger – ve | 653 |
| 16 | 386962 | 388480 | 1518 | loss | 1758 | NME4 | 5.92 | Exon + ve, 5 > ASD > 1, Normals > 1, Sanger – ve | 653 |
| 16 | 386962 | 402342 | 15380 | loss | 1810 | NME4 | 5.92 | Exon + ve, 5 > ASD > 1, Normals > 1, Sanger – ve | 654 |
| 16 | 386962 | 388480 | 1518 | loss | 1865 | NME4 | 5.92 | Exon + ve, 5 > ASD > 1, Normals > 1, Sanger – ve | 653 |
| 16 | 759120 | 764070 | 4950 | loss | 1242 | MIR662, MSLNL | 11.92 | Exon + ve, 5 > ASD > 1, Normals > 1, Sanger – ve | 379 |
| 16 | 759120 | 764070 | 4950 | loss | 1257 | MIR662, MSLNL | 11.92 | Genic (distinct CNV-subregions); OR > 6 | 379 |
| 16 | 759120 | 764070 | 4950 | loss | 1282 | MIR662, MSLNL | 11.92 | Genic (distinct CNV-subregions); OR > 6 | 379 |
| 16 | 759120 | 1950 | 1950 | loss | 1344 | MIR662, MSLNL | 11.92 | Genic (distinct CNV-subregions); OR > 6 | 379 |
| 16 | 759120 | 764070 | 4950 | loss | 1346 | MIR662, MSLNL | 11.92 | Genic (distinct CNV-subregions); OR > 6 | 379 |
| 16 | 759120 | 764070 | 4950 | loss | 1369 | MIR662, MSLNL | 11.92 | Genic (distinct CNV-subregions); OR > 6 | 379 |
| 16 | 759120 | 764070 | 4050 | loss | 1386 | MIR662, MSLNL | 11.92 | Genic (distinct CNV-subregions); OR > 6 | 379 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 16 | 759120 | 764070 | 4950 | loss | 1387 | MIR662, MSLNL | 11.92 | Genic (distinct CNV-subregions); OR > 6 | 379 |
| 16 | 759120 | 764070 | 4950 | loss | 1405 | MIR662, MSLNL | 11.92 | Genic (distinct CNV-subregions); OR > 6 | 379 |
| 16 | 759120 | 764070 | 1950 | loss | 1410 | MIR662, MSLNL | 11.92 | Genic (distinct CNV-subregions); OR > 6 | 379 |
| 16 | 759120 | 764070 | 1950 | loss | 1419 | MIR662, MSLNL | 11.92 | Genic (distinct CNV-subregions); OR > 6 | 379 |
| 16 | 759120 | 764070 | 1950 | loss | 1468 | MIR662, MSLNL | 11.92 | Genic (distinct CNV-subregions); OR > 6 | 379 |
| 16 | 759120 | 764070 | 4950 | loss | 1485 | MIR662, MSLNL | 11.92 | Genic (distinct CNV-subregions); OR > 6 | 379 |
| 16 | 759120 | 764070 | 4950 | loss | 1512 | MIR662, MSLNL | 11.92 | Genic (distinct CNV-subregions); OR > 6 | 379 |
| 16 | 759120 | 764070 | 4950 | loss | 1532 | MIR662, MSLNL | 11.92 | Genic (distinct CNV-subregions); OR > 6 | 379 |
| 16 | 759120 | 764070 | 4950 | loss | 1540 | MIR662, MSLNL | 11.92 | Genic (distinct CNV-subregions); OR > 6 | 379 |
| 16 | 759120 | 823948 | 64828 | gain | 1628 | MIR662, MSLNL | 11.92 | Genic (distinct CNV-subregions); OR > 6 | 380 |
| 16 | 759120 | 764070 | 4950 | loss | 1649 | MIR662, MSLNL | 11.92 | Genic (distinct CNV-subregions); OR > 6 | 379 |
| 16 | 759120 | 764070 | 4950 | loss | 1653 | MIR662, MSLNL | 11.92 | Genic (distinct CNV-subregions); OR > 6 | 379 |
| 16 | 759120 | 764070 | 4950 | loss | 1709 | MIR662, MSLNL | 11.92 | Genic (distinct CNV-subregions); OR > 6 | 379 |
| 16 | 759120 | 764070 | 4950 | loss | 1721 | MIR662, MSLNL | 11.92 | Genic (distinct CNV-subregions); OR > 6 | 379 |
| 16 | 759120 | 764070 | 4950 | loss | 1722 | MIR662, MSLNL | 11.92 | Genic (distinct CNV-subregions); OR > 6 | 379 |
| 16 | 759120 | 764070 | 4950 | loss | 1723 | MIR662, MSLNL | 11.92 | Genic (distinct CNV-subregions); OR > 6 | 379 |
| 16 | 759120 | 764070 | 4950 | loss | 1776 | MIR662, MSLNL | 11.92 | Genic (distinct CNV-subregions); OR > 6 | 379 |
| 16 | 759120 | 764070 | 4950 | loss | 1788 | MIR662, MSLNL | 11.92 | Genic (distinct CNV-subregions); OR > 6 | 379 |
| 16 | 759120 | 764070 | 4950 | loss | 1903 | MIR662, MSLNL | 11.92 | Genic (distinct CNV-subregions); OR > 6 | 379 |
| 16 | 759120 | 764070 | 4950 | loss | 1905 | MIR662, MSLNL | 11.92 | Genic (distinct CNV-subreaions); OR > 6 | 379 |
| 16 | 759120 | 764070 | 4950 | loss | 1923 | MIR662, MSLNL | 11.92 | Genic (distinct CNV-subregions); OR > 6 | 379 |
| 16 | 759120 | 764070 | 4950 | loss | 1959 | MIR662, MSLNL | 11.92 | Genic (distinct CNV-subregions); OR > 6 | 379 |
| 16 | 759120 | 764070 | 4950 | loss | 2034 | MIR662, MSLNL | 11.92 | Genic (distinct CNV-subregions); OR > 6 | 379 |
| 16 | 759120 | 764070 | 4950 | loss | 2040 | MIR662, MSLNL | 11.92 | Genic (distinct CNV-subregions); OR > 6 | 379 |
| 16 | 759120 | 823948 | 64828 | gain | 1628 | PRR25, MSLNL, RPUSD1, CHTF18, GNG13 | 11.92 | Genic (distinct CNV-subregions); OR > 6 | 380 |
| 16 | 3361009 | 5067233 | 1706224 | gain | 1567 | CLUAP1, SLX4,ZNF174, ZNF434, ZNF597, C16orf90, NAT15, NLRC3, MTRNR2L4 | 1.47 | MTRNR2L_family | 62 |
| 16 | 3361009 | 5067233 | 1706224 | gain | 1567 | LOC342346 | 2.95 | Exon + ve, 5 > ASD > 1, Normals < 2, Sanger − ve | 62 |
| 16 | 4554395 | 4588011 | 33616 | loss | 1689 | LOC342346 | 2.95 | Exon + ve, 5 > ASD > 1, Normals < 2, Sanger − ve | 806 |
| 16 | 18072714 | 18645462 | 572748 | gain | 1965 | ABCC6P1 | 4.44 | Exon + ve, 5 > ASD > 1, Normals < 2, Sanger − ve | 721 |
| 16 | 18516136 | 18772626 | 256490 | gain | 1714 | ABCC6P1 | 4.44 | Exon + ve, 5 > ASD > 1, Normals < 2, Sanger − ve | 719 |
| 16 | 18516136 | 18645462 | 129326 | gain | 1811 | ABCC6P1 | 4.44 | Exon + ve, 5 > ASD > 1, Normals < 2, Sanger − ve | 720 |
| 16 | 29238804 | 30106808 | 868004 | loss | 1671 | SPN | 8.91 | Exon + ve, ASD > 4, Normals < 2, no Sanger filter applied | 489 |
| 16 | 29238804 | 30106808 | 868004 | loss | 1671 | MVP, KCTD13, INO80E, ASPHD1, DOC2A, MAZ, ZG16, LOC440356, PRRT2, C16orf92,TAOK2, C16orf53,TMEM219, HIRIP3, SE26L2, FAM57B, C16orf54, CDIPT | 8.91 | Exon + ve, ASD > 4, Normals < 2, no Sanger filter applied | 489 |
| 16 | 29238804 | 30106808 | 868004 | loss | 1671 | | 7.42 | Exon + ve, ASD > 4, Normals < 2, no Sanger filter applied | 489 |
| 16 | 29238804 | 30106808 | 868004 | loss | 1671 | ALDOA, GDPD3, PPP4C, TBX6, YPEL3 | 7.42 | Exon + ve, ASD > 4, Normals < 2, no Sanger filter applied | 489 |
| 16 | 29238804 | 30106808 | 868004 | loss | 1671 | CORO1A | 5.92 | Exon + ve, 5 > ASD > 1, Normals < 2, Sanger − ve | 489 |
| 16 | 29619548 | 29619548 | 59048 | gain | 1608 | SPN | 8.91 | Exon + ve, ASD > 4, Normals < 2, no Sanger filter applied | 488 |
| 16 | 29560500 | 30106808 | 546308 | gain | 1700 | SPN | 8.91 | Exon + ve, ASD > 4, Normals < 2, no Sanger filter applied | 490 |
| 16 | 29560500 | 30106808 | 546308 | loss | 1823 | SPN | 8.91 | Exon + ve, ASD > 4, Normals < 2, no Sanger filter applied | 490 |
| 16 | 29560500 | 30106808 | 546308 | loss | 1893 | SPN | 8.91 | Exon + ve, ASD > 4, Normals < 2, no Sanger filter applied | 490 |
| 16 | 30090559 | 30090559 | 539059 | gain | 1968 | SPN | 8.91 | Exon + ve, ASD > 4, Normals < 2, no Sanger filter applied | 491 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 16 | 29560500 | 29619548 | 59048 | gain | 1608 | QPRT | 8.91 | Exon + ve, ASD > 4, Normals < 2, no Sanger filter applied | 488 |
| 16 | 29560500 | 30106808 | 546308 | gain | 1700 | QPRT | 8.91 | Exon + ve, ASD > 4, Normals < 2, no Sanger filter applied | 490 |
| 16 | 29560500 | 30106808 | 546308 | loss | 1823 | QPRT | 8.91 | Exon + ve, ASD > 4, Normals < 2, no Sanger filter applied | 490 |
| 16 | 29560500 | 30106808 | 546308 | loss | 1893 | QPRT | 8.91 | Exon + ve, ASD > 4, Normals < 2, no Sanger filter applied | 490 |
| 16 | 29560500 | 30099559 | 539059 | gain | 1968 | QPRT | 8.91 | Exon + ve, ASD > 4, Normals < 2, no Sanger filter applied | 491 |
| 16 | 29560500 | 30106808 | 546308 | gain | 1700 | MVP, KCTD13, INO80E, ASPHD1, DOC2A, MAZ, ZG16, LOC440356, PRRT2, C16orf92,TAOK2, C16orf53,TMEM219, HIRIP3, SEZ6L2, FAM57B, C16orf54, CDIPT | 7.42 | Exon + ve, ASD > 4, Normals < 2, no Sanger filter applied | 490 |
| 16 | 29560500 | 30106808 | 546308 | loss | 1823 | MVP, KCTD13, INO80E, ASPHD1, DOC2A, MAZ, ZG16, LOC440356, PRRT2, C16orf92,TAOK2, C16orf53,TMEM219, HIRIP3, SEZ6L2, FAM57B, C16orf54, CDIPT | 7.42 | Exon + ve, ASD > 4, Normals < 2, no Sanger filter applied | 490 |
| 16 | 29560500 | 30106808 | 546308 | loss | 1893 | MVP, KCTD13, INO80E, ASPHD1, DOC2A, MAZ, ZG16, LOC440356, PRRT2, C16orf92,TAOK2, C16orf53,TMEM219, HIRIP3, SEZ6L2, FAM57B, C16orf54, CDIPT | 7.42 | Exon + ve, ASD > 4, Normals < 2, no Sanger filter applied | 490 |
| 16 | 29560500 | 30099559 | 539059 | gain | 1968 | MVP, KCTD13, INO80E, ASPHD1, DOC2A, MAZ, ZG16, LOC440356, PRRT2, C16orf92,TAOK2, C16orf53,TMEM219, HIRIP3, SEZ6L2, FAM57B, C16orf54, CDIPT | 7.42 | Exon + ve, ASD > 4, Normals < 2, no Sanger filter applied | 491 |
| 16 | 29560500 | 30106808 | 546308 | gain | 1700 | ALDOA, GDPD3, PPP4C, TBX6, YPEL3 | 7.42 | Exon + ve, ASD > 4, Normals < 2, no Sanger filter applied | 490 |
| 16 | 29560500 | 30106808 | 546308 | loss | 1823 | ALDOA, GDPD3, PPP4C, TBX6, YPEL3 | 7.42 | Exon + ve, ASD > 4, Normals < 2, no Sanger filter applied | 490 |
| 16 | 29560500 | 30106808 | 546308 | loss | 1893 | ALDOA, GDPD3, PPP4C, TBX6, YPEL3 | 7.42 | Exon + ve, ASD > 4, Normals < 2, no Sanger filter applied | 490 |
| 16 | 29560500 | 30099559 | 539059 | gain | 1968 | ALDOA, GDPD3, PPP4C, TBX6, YPEL3 | 7.42 | Exon + ve, ASD > 4, Normals < 2, no Sanger filter applied | 491 |
| 16 | 29560500 | 30106808 | 546308 | gain | 1700 | CORO1A | 5.92 | Exon + ve, 5 > ASD > 1, Normals < 2, Sanger − ve | 490 |
| 16 | 29560500 | 30106808 | 546308 | loss | 1823 | CORO1A | 5.92 | Exon + ve, 5 > ASD > 1, Normals < 2, Sanger − ve | 490 |
| 16 | 29560500 | 30106808 | 546308 | loss | 1893 | CORO1A | 5.92 | Exon + ve, 5 > ASD > 1, Normals < 2, Sanger − ve | 490 |
| 16 | 68710277 | 68850394 | 140117 | loss | 1538 | CLEC18C, LOC729513 | 10.41 | Exon + ve, ASD > 4, Normals < 2, no Sanger filter applied | 419 |
| 16 | 68710277 | 68842364 | 132087 | loss | 1742 | CLEC18C, LOC729513 | 10.41 | Exon + ve, ASD > 4, Normals < 2, no Sanger filter applied | 420 |
| 16 | 68710277 | 68838384 | 128107 | loss | 1792 | CLEC18C, LOC729513 | 10.41 | Exon + ve, ASD > 4, Normals < 2, no Sanger filter applied | 421 |
| 16 | 68710277 | 68859920 | 149643 | loss | 1793 | CLEC18C, LOC729513 | 10.41 | Exon + ve, ASD > 4, Normals < 2, no Sanger filter applied | 122 |
| 16 | 68710277 | 68842364 | 132087 | loss | 1935 | CLEC18C, LOC729513 | 10.41 | Exon + ve, ASD > 4, Normals < 2, no Sanger filter applied | 420 |
| 16 | 68710277 | 68850394 | 140117 | loss | 1538 | EXOSC6 | 7.42 | Exon + ve, ASD > 4, Normals < 2, no Sanger filter applied | 419 |
| 16 | 68710277 | 68842364 | 132087 | loss | 1742 | EXOSC6 | 7.42 | Exon + ve, ASD > 4, Normals < 2, no Sanger filter applied | 420 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 16 | 68710277 | 68859920 | 149643 | loss | 1793 | EXOSC6 | 7.42 | Exon + ve, ASD > 4, Normals < 2, no Sanger filter applied | 422 |
| 16 | 68710277 | 68842364 | 132087 | loss | 1935 | EXOSC6 | 7.42 | Exon + ve, ASD > 4, Normals < 2, no Sanger filter applied | 420 |
| 16 | 68732367 | 68844016 | 111649 | gain | 1323 | CLEC18C, LOC729513 | 10.41 | Exon + ve, ASD > 4, Normals < 2, no Sanger filter applied | 418 |
| 16 | 68732367 | 68844016 | 111649 | gain | 1875 | CLEC18C, LOC729513 | 10.41 | Exon + ve, ASD > 4, Normals < 2, no Sanger filter applied | 423 |
| 16 | 68732367 | 68838384 | 106017 | gain | 1323 | EXOSC6 | 7.42 | Exon + ve, ASD > 4, Normals < 2, no Sanger filter applied | 118 |
| 16 | 70641420 | 70665447 | 24027 | loss | 1775 | HPR | 13.43 | Exon + ve, ASD > 4, Normals < 2, no Sanger filter applied | 349 |
| 16 | 70653499 | 70665447 | 11948 | gain | 1489 | HPR | 13.43 | Exon + ve, ASD > 4, Normals < 2, no Sanger filter applied | 348 |
| 16 | 70653499 | 70665447 | 11948 | gain | 1497 | HPR | 13.43 | Exon + ve, ASD > 4, Normals < 2, no Sanger filter applied | 348 |
| 16 | 70653499 | 70665447 | 11948 | gain | 1723 | HPR | 13.43 | Exon + ve, ASD > 4, Normals < 2, no Sanger filter applied | 348 |
| 16 | 70653499 | 70665447 | 11948 | gain | 1731 | HPR | 13.43 | Exon + ve, ASD > 4, Normals < 2, no Sanger filter applied | 348 |
| 16 | 70653499 | 70665447 | 11948 | gain | 1734 | HPR | 13.43 | Exon + ve, ASD > 4, Normals < 2, no Sanger filter applied | 348 |
| 16 | 70653499 | 70665447 | 11948 | gain | 1737 | HPR | 13.43 | Exon + ve, ASD > 4, Normals < 2, no Sanger filter applied | 348 |
| 16 | 70652499 | 70665147 | 11948 | gain | 1877 | HPR | 13.43 | Exon + ve, ASD > 4, Normals < 2, no Sanger filter applied | 348 |
| 16 | 70653499 | 70665447 | 11948 | gain | 2034 | HPR | 13.43 | Exon + ve, ASD > 4, Normals < 2, no Sanger filter applied | 348 |
| 16 | 72918129 | 72964783 | 46654 | gain | 1440 | LOC283922 | 7.42 | Exon + ve, ASD > 4, Normals < 2, no Sanger filter applied | 606 |
| 16 | 72918129 | 72964783 | 46654 | gain | 1490 | LOC283922 | 7.42 | Exon + ve, ASD > 4, Normals < 2, no Sanger filter applied | 606 |
| 16 | 72918129 | 72964783 | 46654 | gain | 1499 | LOC283922 | 7.42 | Exon + ve, ASD > 4, Normals < 2, no Sanger filter applied | 606 |
| 16 | 72918129 | 72964783 | 46654 | gain | 1521 | LOC283922 | 7.42 | Exon + ve, ASD > 4, Normals < 2, no Sanger filter applied | 606 |
| 16 | 72918129 | 72964783 | 46654 | gain | 1913 | LOC283922 | 7.42 | Exon + ve, ASD > 4, Normals < 2, no Sanger filter applied | 606 |
| 16 | 72929786 | 73040905 | 111119 | loss | 1263 | GLG1 | 4.44 | Exon + ve, 5 > ASD > 1, Normals < 2, Sanger – ve | 722 |
| 16 | 72929786 | 73040905 | 111119 | loss | 1285 | GLG1 | 4.44 | Exon + ve, 5 > ASD > 1, Normals < 2, Sanger – ve | 722 |
| 16 | 72929786 | 73044781 | 114995 | loss | 1831 | GLG1 | 4.44 | Exon + ve, 5 > ASD > 1, Normals < 2, Sanger – ve | 723 |
| 16 | 75003957 | 75100865 | 6908 | gain | 1423 | CNTNAP4 | 10.41 | Intron + ve, ASD > 4, Normals < 2, no Sanger filter applied | 424 |
| 16 | 75093957 | 75100865 | 6908 | gain | 1793 | CNTNAP4 | 10.41 | Intron + ve, ASD > 4, Normals < 2, no Sanger filter applied | 424 |
| 16 | 75093957 | 75100865 | 6908 | gain | 1807 | CNTNAP4 | 10.41 | Intron + ve, ASD > 4, Normals < 2, no Sanger filter applied | 424 |
| 16 | 75093957 | 75100865 | 6908 | gain | 1823 | CNTNAP4 | 10.41 | Intron + ve, ASD > 4, Normals < 2, no Sanger filter applied | 424 |
| 16 | 75093957 | 75100865 | 6908 | gain | 1860 | CNTNAP4 | 10.41 | Intron + ve, ASD > 4, Normals < 2, no Sanger filter applied | 424 |
| 16 | 75093957 | 75100865 | 6908 | gain | 1923 | CNTNAP4 | 10.41 | Intron + ve, ASD > 4, Normals < 2, no Sanger filter applied | 424 |
| 16 | 75093957 | 75100865 | 6908 | gain | 2035 | CNTNAP4 | 10.41 | Intron + ve, ASD > 4, Normals < 2, no Sanger filter applied | 424 |
| 16 | 76348665 | 77371827 | 1023162 | gain | 1851 | CLEC3A | 4.44 | Exon + ve, 5 > ASD > 1, Normals < 2, Sanger – ve | 299 |
| 16 | 76348665 | 77371827 | 1023162 | gain | 1851 | CLEC3A | 4.44 | Exon + ve, 5 > ASD > 1, Normals < 2, Sanger – ve | 299 |
| 16 | 76494618 | 76634178 | 139560 | loss | 1676 | CLEC3A | 4.44 | Exon + ve, 5 > ASD > 1, Normals < 2, Sanger – ve | 725 |
| 16 | 76617253 | 76630181 | 12928 | gain | 1489 | CLEC3A | 4.44 | Exon + ve, 5 > ASD > 1, Normals < 2, Sanger – ve | 724 |
| 16 | 76925748 | 76940218 | 14470 | gain | 1258 | WWOX | 14.94 | Intron + ve, ASD > 4, Normals < 2, no Sanger filter applied | 296 |
| 16 | 76925748 | 76942679 | 16931 | gain | 1333 | WWOX | 14.94 | Intron + ve, ASD > 4, Normals < 2, no Sanger filter applied | 297 |
| 16 | 76925748 | 76940218 | 14470 | gain | 1354 | WWOX | 14.94 | Intron + ve, ASD > 4, Normals < 2, no Sanger filter applied | 296 |
| 16 | 76925748 | 76940218 | 14470 | gain | 1436 | WWOX | 14.94 | Intron + ve, ASD > 4, Normals < 2, no Sanger filter applied | 296 |
| 16 | 76925748 | 76942679 | 16931 | gain | 1454 | WWOX | 14.94 | Intron + ve, ASD > 4, Normals < 2, no Sanger filter applied | 297 |
| 16 | 76925748 | 76940218 | 14470 | gain | 1605 | WWOX | 14.94 | Intron + ve, ASD > 4, Normals < 2, no Sanger filter applied | 296 |
| 16 | 76925748 | 76944661 | 18913 | gain | 1683 | WWOX | 14.94 | Intron + ve, ASD > 4, Normals < 2, no Sanger filter applied | 298 |
| 16 | 76925748 | 76940218 | 14470 | gain | 1925 | WWOX | 14.94 | Intron + ve, ASD > 4, Normals < 2, no Sanger filter applied | 296 |
| 16 | 76925748 | 76942679 | 16931 | gain | 1969 | WWOX | 14.94 | Intron + ve, ASD > 4, Normals < 2, no Sanger filter applied | 297 |
| 17 | 4617676 | 4629625 | 11952 | loss | 1692 | TM4SF5 | 2.95 | Exon + ve, 5 > ASD > 1, Normals < 2, Sanger – ve | 807 |
| 17 | 4617676 | 4629628 | 11952 | loss | 1924 | TM4SF5 | 2.95 | Exon + ve, 5 > ASD > 1, Normals < 2, Sanger – ve | 807 |
| 17 | 12135773 | 12441508 | 5735 | gain | 1520 | FLJ34690 | 10.41 | Intron + ve, ASD > 4, Normals < 2, no Sanger filter applied | 426 |
| 17 | 12435897 | 12441508 | 5611 | loss | 1416 | FLJ34690 | 10.41 | Intron + ve, ASD > 4, Normals < 2, no Sanger filter applied | 425 |
| 17 | 12435897 | 12441508 | 5611 | loss | 1676 | FLJ34690 | 10.41 | Intron + ve, ASD > 4, Normals < 2, no Sanger filter applied | 425 |
| 17 | 12435897 | 12441508 | 5611 | loss | 1678 | FLJ34690 | 10.41 | Intron + ve, ASD > 4, Normals < 2, no Sanger filter applied | 425 |
| 17 | 12435897 | 12441508 | 5611 | loss | 1852 | FLJ34690 | 10.41 | Intron + ve, ASD > 4, Normals < 2, no Sanger filter applied | 425 |
| 17 | 12435897 | 12441508 | 5611 | loss | 1878 | FLJ34690 | 10.41 | Intron + ve, ASD > 4, Normals < 2, no Sanger filter applied | 425 |
| 17 | 12435897 | 12441508 | 5611 | loss | 2028 | FLJ34690 | 10.41 | Intron + ve, ASD > 4, Normals < 2, no Sanger filter applied | 425 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 17 | 21628739 | 22142513 | 513774 | gain | 1451 | MTRNR2L1 | 5.92 | MTRNR2L_family | 55 |
| 17 | 21628739 | 22032563 | 103824 | gain | 1584 | MTRNR2L1 | 5.92 | MTRNR2L_family | 56 |
| 17 | 21628739 | 22129889 | 501150 | loss | 1743 | MTRNR2L1 | 5.92 | MTRNR2L_family | 57 |
| 17 | 21845327 | 22142513 | 297186 | gain | 1837 | MTRNR2L1 | 5.92 | MTRNR2L_family | 58 |
| 17 | 32830127 | 32833765 | 3638 | gain | 1252 | ACACA | 13.43 | Intron + ve, ASD > 4, Normals < 2, no Sanger filter applied | 350 |
| 17 | 32830127 | 32833765 | 3638 | gain | 1285 | ACACA | 13.43 | Intron + ve, ASD > 4, Normals < 2, no Sanger filter applied | 350 |
| 17 | 32830127 | 32833765 | 3638 | gain | 1372 | ACACA | 13.43 | Intron + ve, ASD > 4, Normals < 2, no Sanger filter applied | 350 |
| 17 | 32830127 | 32833765 | 3638 | gain | 1407 | ACACA | 13.43 | Intron + ve, ASD > 4, Normals < 2, no Sanger filter applied | 350 |
| 17 | 32830127 | 32833765 | 3638 | gain | 1434 | ACACA | 13.43 | Intron + ve, ASD > 4, Normals < 2, no Sanger filter applied | 350 |
| 17 | 32830127 | 32833765 | 3638 | gain | 1573 | ACACA | 13.43 | Intron + ve, ASD > 4, Normals < 2, no Sanger filter applied | 350 |
| 17 | 32830127 | 32833765 | 3638 | gain | 1617 | ACACA | 13.43 | Intron + ve, ASD > 4, Normals < 2, no Sanger filter applied | 350 |
| 17 | 32830127 | 32833765 | 3638 | gain | 1825 | ACACA | 13.43 | Intron + ve, ASD > 4, Normals < 2, no Sanger filter applied | 350 |
| 17 | 32830127 | 32833765 | 3638 | gain | 2042 | ACACA | 13.43 | Intron + ve, ASD > 4, Normals < 2, no Sanger filter applied | 350 |
| 17 | 40209353 | 40213056 | 3703 | loss | 1836 | ADAM11 | 2.95 | Exon + ve, 5 > ASD > 1, Normals < 2, Sanger − ve | 808 |
| 17 | 40209353 | 40213056 | 3703 | loss | 1955 | ADAM11 | 2.95 | Exon + ve, 5 > ASD > 1, Normals < 2, Sanger − ve | 808 |
| 17 | 41504832 | 41710400 | 205568 | loss | 1320 | KIAA1267 | 8.91 | Intron + ve, ASD > 4, Normals < 2, no Sanger filter applied | 147 |
| 17 | 41504832 | 41710400 | 205568 | loss | 1320 | KIAA1267 | 22.58 | Intron + ve, ASD > 4, Normals < 2, no Sanger filter applied | 147 |
| 17 | 41504832 | 41710400 | 205568 | loss | 1320 | KIAA1267 | 39.79 | Intron + ve, ASD > 4, Normals < 2, no Sanger filter applied | 147 |
| 17 | 41506317 | 41710400 | 204083 | loss | 1319 | KIAA1267 | 8.91 | Intron + ve, ASD > 4, Normals < 2, no Sanger filter applied | 146 |
| 17 | 41506317 | 41710400 | 204083 | loss | 1319 | KIAA1267 | 22.58 | Intron + ve, ASD > 4, Normals < 2, no Sanger filter applied | 146 |
| 17 | 41506317 | 41710400 | 204083 | loss | 1319 | KIAA1267 | 39.79 | Intron + ve, ASD > 4, Normals < 2, no Sanger filter applied | 116 |
| 17 | 41508943 | 42142363 | 633420 | loss | 1542 | KIAA1267 | 8.91 | Intron + ve, ASD > 4, Normals < 2, no Sanger filter applied | 152 |
| 17 | 41508943 | 41710400 | 201457 | loss | 1587 | KIAA1267 | 8.91 | Intron + ve, ASD > 4, Normals < 2, no Sanger filter applied | 153 |
| 17 | 41508943 | 41566540 | 57597 | loss | 1656 | KIAA1267 | 8.91 | Intron + ve, ASD > 4, Normals < 2, no Sanger filter applied | 155 |
| 17 | 41508943 | 41579322 | 70379 | loss | 1861 | KIAA1267 | 8.91 | Intron + ve, ASD > 4, Normals < 2, no Sanger filter applied | 157 |
| 17 | 41508943 | 42142363 | 633420 | loss | 1542 | KIAA1267 | 22.58 | Intron + ve, ASD > 4, Normals < 2, no Sanger filter applied | 152 |
| 17 | 41508943 | 41710400 | 201457 | loss | 1587 | KIAA1267 | 22.58 | Intron + ve, ASD > 4, Normals < 2, no Sanger filter applied | 153 |
| 17 | 41508943 | 41566540 | 57597 | loss | 1656 | KIAA1267 | 22.58 | Intron + ve, ASD > 4, Normals < 2, no Sanger filter applied | 155 |
| 17 | 41508943 | 41579322 | 70379 | loss | 1861 | KIAA1267 | 22.58 | Intron + ve, ASD > 4, Normals < 2, no Sanger filter applied | 157 |
| 17 | 41508943 | 42142363 | 633420 | loss | 1542 | KIAA1267 | 39.79 | Intron + ve, ASD > 4, Normals < 2, no Sanger filter applied | 152 |
| 17 | 41508943 | 41710400 | 201457 | loss | 1587 | KIAA1267 | 39.79 | Intron + ve, ASD > 4, Normals < 2, no Sanger filter applied | 153 |
| 17 | 41508943 | 41566540 | 57597 | loss | 1656 | KIAA1267 | 39.79 | Intron + ve, ASD > 4, Normals < 2, no Sanger filter applied | 155 |
| 17 | 41508943 | 41579322 | 70379 | loss | 1861 | KIAA1267 | 39.79 | Intron + ve, ASD > 4, Normals < 2, no Sanger filter applied | 157 |
| 17 | 41512318 | 41710400 | 198082 | loss | 1530 | KIAA1267 | 22.58 | Intron + ve, ASD > 4, Normals < 2, no Sanger filter applied | 150 |
| 17 | 41512318 | 41710400 | 198082 | loss | 1533 | KIAA1267 | 22.58 | Intron + ve, ASD > 4, Normals < 2, no Sanger filter applied | 150 |
| 17 | 41512318 | 41710400 | 198082 | loss | 1535 | KIAA1267 | 22.58 | Intron + ve, ASD > 4, Normals < 2, no Sanger filter applied | 150 |
| 17 | 41512318 | 41710400 | 198082 | loss | 1536 | KIAA1267 | 22.58 | Intron + ve, ASD > 4, Normals < 2, no Sanger filter applied | 150 |
| 17 | 41512318 | 42151941 | 639623 | loss | 1537 | KIAA1267 | 22.58 | Intron + ve, ASD > 4, Normals < 2, no Sanger filter applied | 151 |
| 17 | 41512318 | 41710400 | 198082 | loss | 1539 | KIAA1267 | 22.58 | Intron + ve, ASD > 4, Normals < 2, no Sanger filter applied | 150 |
| 17 | 41512318 | 41710400 | 198082 | loss | 1586 | KIAA1267 | 22.58 | Intron + ve, ASD > 4, Normals < 2, no Sanger filter applied | 150 |
| 17 | 41512318 | 42142363 | 630045 | loss | 1662 | KIAA1267 | 22.58 | Intron + ve, ASD > 4, Normals < 2, no Sanger filter applied | 156 |
| 17 | 41512318 | 41710400 | 198082 | loss | 1684 | KIAA1267 | 22.58 | Intron + ve, ASD > 4, Normals < 2, no Sanger filter applied | 150 |
| 17 | 41512318 | 41710400 | 198082 | loss | 1530 | KIAA1267 | 39.79 | Intron + ve, ASD > 4, Normals < 2, no Sanger filter applied | 150 |
| 17 | 41512318 | 41710400 | 198082 | loss | 1533 | KIAA1267 | 39.79 | Intron + ve, ASD > 4, Normals < 2, no Sanger filter applied | 150 |
| 17 | 41512318 | 41710400 | 198082 | loss | 1535 | KIAA1267 | 39.70 | Intron + ve, ASD > 4, Normals < 2, no Sanger filter applied | 150 |
| 17 | 41512318 | 41710400 | 198082 | loss | 1536 | KIAA1267 | 39.79 | Intron + ve, ASD > 4, Normals < 2, no Sanger filter applied | 150 |
| 17 | 41512318 | 42151941 | 639623 | loss | 1537 | KIAA1267 | 39.79 | Intron + ve, ASD > 4, Normals < 2, no Sanger filter applied | 151 |
| 17 | 41512318 | 41710400 | 198082 | loss | 1539 | KIAA1267 | 39.79 | Intron + ve, ASD > 4, Normals < 2, no Sanger filter applied | 150 |
| 17 | 41512318 | 41710400 | 198082 | loss | 1586 | KIAA1267 | 39.79 | Intron + ve, ASD > 4, Normals < 2, no Sanger filter applied | 150 |
| 17 | 41512318 | 42142363 | 630045 | loss | 1662 | KIAA1267 | 39.79 | Intron + ve, ASD > 4, Normals < 2, no Sanger filter applied | 156 |
| 17 | 41512318 | 41710100 | 198082 | loss | 1684 | KIAA1267 | 39.79 | Intron + ve, ASD > 4, Normals < 2, no Sanger filter applied | 150 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 17 | 41512318 | 42151941 | 639623 | loss | 1536 | NSF | 14.94 | Intron + ve, ASD > 4, Normals < 2, no Sanger filter applied | 151 |
| 17 | 41514481 | 41710400 | 195919 | loss | 1655 | KIAA1267 | 39.79 | Intron + ve, ASD > 4, Normals < 2, no Sanger filter applied | 154 |
| 17 | 41518222 | 41647135 | 128913 | gain | 1394 | KIAA1267 | 39.79 | Intron + ve, ASD > 4, Normals < 2, no Sanger filter applied | 148 |
| 17 | 41518222 | 41710400 | 192178 | loss | 1465 | KIAA1267 | 39.79 | Intron + ve, ASD > 4, Normals < 2, no Sanger filter applied | 149 |
| 17 | 41518222 | 41710400 | 192178 | loss | 1675 | KIAA1267 | 39.79 | Intron + ve, ASD > 4, Normals < 2, no Sanger filter applied | 149 |
| 17 | 41518222 | 41710400 | 192178 | loss | 1734 | KIAA1267 | 39.79 | Intron + ve, ASD > 4, Normals < 2, no Sanger filter applied | 149 |
| 17 | 41518222 | 41710400 | 192178 | gain | 1840 | KIAA1267 | 39.79 | Intron + ve, ASD > 4, Normals < 2, no Sanger filter applied | 149 |
| 17 | 41518222 | 41710400 | 192178 | gain | 1844 | KIAA1267 | 39.79 | Intron + ve, ASD > 4, Normals < 2, no Sanger filter applied | 149 |
| 17 | 41518222 | 41710400 | 192178 | gain | 1869 | KIAA1267 | 39.79 | Intron + ve, ASD > 4, Normals < 2, no Sanger filter applied | 149 |
| 17 | 41518222 | 41710400 | 192178 | gain | 1887 | KIAA1267 | 39.79 | Intron + ve, ASD > 4, Normals < 2, no Sanger filter applied | 149 |
| 17 | 41518222 | 41710400 | 192178 | gain | 1907 | KIAA1267 | 39.79 | Intron + ve, ASD > 4, Normals < 2, no Sanger filter applied | 149 |
| 17 | 41518222 | 41710400 | 192178 | gain | 1914 | KIAA1267 | 39.79 | Intron + ve, ASD > 4, Normals < 2, no Sanger filter applied | 149 |
| 17 | 41521544 | 42148637 | 627093 | gain | 1671 | NSF | 14.94 | Intron + ve, ASD > 4, Normals < 2, no Sanger filter applied | 302 |
| 17 | 41521544 | 42148637 | 627093 | gain | 1751 | NSF | 14.94 | Intron + ve, ASD > 4, Normals < 2, no Sanger filter applied | 302 |
| 17 | 41527705 | 42143048 | 615343 | loss | 1250 | NSF | 14.94 | Intron + ve, ASD > 4, Normals < 2, no Sanger filter applied | 300 |
| 17 | 41527705 | 42143048 | 615343 | loss | 1436 | NSF | 14.94 | Intron + ve, ASD > 4, Normals < 2, no Sanger filter applied | 300 |
| 17 | 41568539 | 42143048 | 574509 | loss | 1266 | NSF | 14.94 | Intron + ve, ASD > 4, Normals < 2, no Sanger filter applied | 301 |
| 17 | 41568539 | 42151941 | 583402 | gain | 1800 | NSF | 14.94 | Intron + ve, ASD > 4, Normals < 2, no Sanger filter applied | 303 |
| 17 | 41568539 | 42147225 | 578686 | gain | 2032 | NSF | 14.94 | Intron + ve, ASD > 4, Normals < 2, no Sanger filter applied | 305 |
| 17 | 41568539 | 42143048 | 574509 | gain | 2036 | NSF | 14.94 | Intron + ve, ASD > 4, Normals < 2, no Sanger filter applied | 301 |
| 17 | 41706870 | 42147225 | 440355 | gain | 1991 | NSF | 14.94 | Intron + ve, ASD > 4, Normals < 2, no Sanger filter applied | 304 |
| 17 | 57327446 | 57336509 | 9063 | loss | 1439 | INTS2 | 7.42 | Intron + ve, ASD > 4, Normals < 2, no Sanger filter applied | 607 |
| 17 | 57327446 | 57336509 | 9063 | loss | 1601 | INTS2 | 7.42 | Intron + ve, ASD > 4, Normals < 2, no Sanger filter applied | 607 |
| 17 | 57327446 | 57336828 | 9382 | loss | 1641 | INTS2 | 7.42 | Intron + ve, ASD > 4, Normals < 2, no Sanger filter applied | 608 |
| 17 | 57329783 | 57336509 | 6726 | loss | 1784 | INTS2 | 7.42 | Intron + ve, ASD > 4, Normals < 2, no Sanger filter applied | 609 |
| 17 | 57331106 | 57336509 | 5403 | gain | 1875 | INTS2 | 7.42 | Intron + ve, ASD > 4, Normals < 2, no Sanger filter applied | 610 |
| 17 | 68327352 | 68336699 | 9347 | loss | 1283 | SLC39A11 | 25.67 | Intron + ve, ASD > 4, Normals < 2, no Sanger filter applied | 229 |
| 17 | 68327352 | 68336699 | 9347 | loss | 1296 | SLC39A11 | 25.67 | Intron + ve, ASD > 4, Normals < 2, no Sanger filter applied | 229 |
| 17 | 68327352 | 68336699 | 9347 | loss | 1306 | SLC39A11 | 25.67 | Intron + ve, ASD > 4, Normals < 2, no Sanger filter applied | 229 |
| 17 | 68327352 | 68336699 | 9347 | loss | 1309 | SLC39A11 | 25.67 | Intron + ve, ASD > 4, Normals < 2, no Sanger filter applied | 229 |
| 17 | 68327352 | 68336699 | 9347 | loss | 1344 | SLC39A11 | 25.67 | Intron + ve, ASD > 4, Normals < 2, no Sanger filter applied | 229 |
| 17 | 68327352 | 68336699 | 9347 | loss | 1370 | SLC39A11 | 25.67 | Intron + ve, ASD > 4, Normals < 2, no Sanger filter applied | 229 |
| 17 | 68327352 | 68336699 | 9347 | loss | 1394 | SLC39A11 | 25.67 | Intron + ve, ASD > 4, Normals < 2, no Sanger filter applied | 229 |
| 17 | 68327352 | 68336699 | 9347 | loss | 1396 | SLC39A11 | 25.67 | Intron + ve, ASD > 4, Normals < 2, no Sanger filter applied | 229 |
| 17 | 68327352 | 68336699 | 9347 | loss | 1410 | SLC39A11 | 25.67 | Intron + ve, ASD > 4, Normals < 2, no Sanger filter applied | 229 |
| 17 | 68327352 | 68336699 | 9347 | loss | 1708 | SLC39A11 | 25.67 | Intron + ve, ASD > 4, Normals < 2, no Sanger filter applied | 229 |
| 17 | 68327352 | 68336699 | 9347 | loss | 1776 | SLC39A11 | 25.67 | Intron + ve, ASD > 4, Normals < 2, no Sanger filter applied | 229 |
| 17 | 68327352 | 68336699 | 9347 | loss | 1831 | SLC39A11 | 25.67 | Intron + ve, ASD > 4, Normals < 2, no Sanger filter applied | 229 |
| 17 | 68327352 | 68336699 | 9347 | loss | 1833 | SLC39A11 | 25.67 | Intron + ve, ASD > 4, Normals < 2, no Sanger filter applied | 229 |
| 17 | 68327352 | 68336699 | 9347 | loss | 1843 | SLC39A11 | 25.67 | Intron + ve, ASD > 4, Normals < 2, no Sanger filter applied | 229 |
| 17 | 68327352 | 68336699 | 9347 | loss | 1898 | SLC39A11 | 25.67 | Intron + ve, ASD > 4, Normals < 2, no Sanger filter applied | 229 |
| 17 | 68327352 | 68336699 | 9317 | loss | 1921 | SLC39A11 | 25.67 | Intron + ve, ASD > 4, Normals < 2, no Sanger filter applied | 229 |
| 17 | 68327352 | 68336699 | 9347 | loss | 1928 | SLC39A11 | 25.67 | Intron + ve, ASD > 4, Normals < 2, no Sanger filter applied | 229 |
| 17 | 68327352 | 68336699 | 9347 | gain | 1831 | SLC39A11 | 25.67 | Intron + ve, ASD > 4, Normals < 2, no Sanger filter applied | 229 |
| 17 | 76213226 | 76227620 | 14394 | gain | 1852 | RPTOR | 4.44 | Exon + ve, 5 > ASD > 1, Normals < 2, Sanger − ve | 726 |
| 17 | 76213226 | 76227620 | 14394 | gain | 1929 | RPTOR | 4.44 | Exon + ve, 5 > ASD > 1, Normals < 2, Sanger − ve | 726 |
| 17 | 76213226 | 76227620 | 14394 | gain | 1389 | RPTOR | 4.44 | Exon + ve, 5 > ASD > 1, Normals < 2, Sanger − ve | 726 |
| 18 | 503208 | 505156 | 2248 | loss | 1284 | | 52.68 | high OR intergenic (OR > 30) | 75 |
| 18 | 503208 | 505156 | 2248 | loss | 1413 | | 52.68 | high OR intergenic (OR > 30) | 75 |
| 18 | 503208 | 506827 | 3619 | loss | 1415 | | 52.68 | high OR intergenic (OR > 30) | 76 |
| 18 | 503208 | 505456 | 2248 | loss | 1439 | | 52.68 | high OR intergenic (OR > 30) | 75 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 18 | 503208 | 505456 | 2248 | loss | 1452 | | 52.68 | high OR intergenic (OR > 30) | 75 |
| 18 | 503208 | 505456 | 2248 | loss | 1464 | | 52.68 | high OR intergenic (OR > 30) | 75 |
| 18 | 503208 | 505456 | 2248 | loss | 1472 | | 52.68 | high OR intergenic (OR > 30) | 75 |
| 18 | 503208 | 505456 | 2248 | loss | 1474 | | 52.68 | high OR intergenic (OR > 30) | 75 |
| 18 | 503208 | 505456 | 2248 | loss | 1495 | | 52.68 | high OR intergenic (OR > 30) | 75 |
| 18 | 503208 | 505456 | 2248 | gain | 1504 | | 52.68 | high OR intergenic (OR > 30) | 75 |
| 18 | 503208 | 505456 | 2248 | loss | 1534 | | 52.68 | high OR intergenic (OR > 30) | 75 |
| 18 | 503208 | 505456 | 2248 | loss | 1545 | | 52.68 | high OR intergenic (OR > 30) | 75 |
| 18 | 503208 | 505456 | 2248 | loss | 1567 | | 52.68 | high OR intergenic (OR > 30) | 75 |
| 18 | 503208 | 505456 | 2248 | loss | 1568 | | 52.68 | high OR intergenic (OR > 30) | 75 |
| 18 | 503208 | 505456 | 2248 | loss | 1572 | | 52.68 | high OR intergenic (OR > 30) | 75 |
| 18 | 503208 | 505456 | 2248 | loss | 1584 | | 52.68 | high OR intergenic (OR > 30) | 75 |
| 18 | 503208 | 505456 | 2248 | gain | 1662 | | 52.68 | high OR intergenic (OR > 30) | 75 |
| 18 | 503208 | 505456 | 2248 | loss | 1672 | | 52.68 | high OR intergenic (OR > 30) | 75 |
| 18 | 503208 | 505456 | 2248 | loss | 1697 | | 52.68 | high OR intergenic (OR > 30) | 75 |
| 18 | 503208 | 505456 | 2248 | loss | 1699 | | 52.68 | high OR intergenic (OR > 30) | 75 |
| 18 | 503208 | 510633 | 7425 | loss | 1703 | | 52.68 | high OR intergenic (OR > 30) | 77 |
| 18 | 503208 | 505456 | 2248 | loss | 1730 | | 52.68 | high OR intergenic (OR > 30) | 75 |
| 18 | 503208 | 505456 | 2248 | gain | 1777 | | 52.68 | high OR intergenic (OR > 30) | 75 |
| 18 | 503208 | 505456 | 2248 | loss | 1802 | | 52.68 | high OR intergenic (OR > 30) | 75 |
| 18 | 503208 | 505456 | 2248 | loss | 1809 | | 52.68 | high OR intergenic (OR > 30) | 75 |
| 18 | 503208 | 505456 | 2248 | loss | 1830 | | 52.68 | high OR intergenic (OR > 30) | 75 |
| 18 | 503208 | 506827 | 3619 | loss | 1870 | | 52.68 | high OR intergenic (OR > 30) | 76 |
| 18 | 503208 | 505456 | 2218 | gain | 1871 | | 52.68 | high OR intergenic (OR > 30) | 75 |
| 18 | 503208 | 505456 | 2248 | loss | 1875 | | 52.68 | high OR intergenic (OR > 30) | 75 |
| 18 | 503208 | 505456 | 2248 | loss | 1968 | | 52.68 | high OR intergenic (OR > 30) | 75 |
| 18 | 503208 | 505456 | 2248 | loss | 1999 | | 52.68 | high OR intergenic (OR > 30) | 75 |
| 18 | 503208 | 505456 | 2248 | loss | 2031 | | 52.68 | high OR intergenic (OR > 30) | 75 |
| 18 | 503208 | 505456 | 2248 | loss | 2044 | | 52.68 | high OR intergenic (OR > 30) | 75 |
| 18 | 17513277 | 17514596 | 1319 | gain | 1250 | ABHD3 | 8.91 | Intron + ve, ASD > 4, Normals < 2, no Sanger filter applied | 492 |
| 18 | 17513277 | 17514596 | 1319 | loss | 1426 | ABHD3 | 8.91 | Intron + ve, ASD > 4, Normals < 2, no Sanger filter applied | 492 |
| 18 | 17513277 | 17514596 | 1319 | loss | 1442 | ABHD3 | 8.91 | Intron + ve, ASD > 4, Normals < 2, no Sanger filter applied | 492 |
| 18 | 17513277 | 17514596 | 1319 | gain | 1611 | ABHD3 | 8.91 | Intron + ve, ASD > 4, Normals < 2, no Sanger filter applied | 492 |
| 18 | 17513277 | 17514596 | 1319 | loss | 1670 | ABHD3 | 8.91 | Intron + ve, ASD > 4, Normals < 2, no Sanger filter applied | 492 |
| 18 | 17513277 | 17514596 | 1319 | gain | 2045 | ABHD3 | 8.91 | Intron + ve, ASD > 4, Normals < 2, no Sanger filter applied | 492 |
| 18 | 48694600 | 48716663 | 22063 | gain | 1354 | DCC | 16.46 | Intron + ve, ASD > 4, Normals < 2, no Sanger filter applied | 7 |
| 18 | 48694600 | 48716663 | 22063 | gain | 1354 | DCC | 25.67 | Intron + ve, ASD > 4, Normals < 2, no Sanger filter applied | 7 |
| 18 | 48694600 | 48716663 | 22063 | gain | 1354 | DCC | 27.22 | Intron + ve, ASD > 4, Normals < 2, no Sanger filter applied | 7 |
| 18 | 48698719 | 48716663 | 17941 | gain | 1227 | DCC | 16.46 | Intron + ve, ASD > 4, Normals < 2, no Sanger filter applied | 6 |
| 18 | 48698719 | 48716663 | 17944 | gain | 1236 | DCC | 16.46 | Intron + ve, ASD > 4, Normals < 2, no Sanger filter applied | 6 |
| 18 | 48698719 | 48716663 | 17944 | gain | 1459 | DCC | 16.46 | Intron + ve, ASD > 4, Normals < 2, no Sanger filter applied | 6 |
| 18 | 48698719 | 48716663 | 17944 | gain | 1464 | DCC | 16.46 | Intron + ve, ASD > 4, Normals < 2, no Sanger filter applied | 6 |
| 18 | 48698719 | 48716663 | 17944 | gain | 1572 | DCC | 16.46 | Intron + ve, ASD > 4, Normals < 2, no Sanger filter applied | 6 |
| 18 | 48698719 | 48716663 | 17944 | gain | 1617 | DCC | 16.46 | Intron + ve, ASD > 4, Normals < 2, no Sanger filter applied | 6 |
| 18 | 48698719 | 48716663 | 17944 | gain | 1792 | DCC | 16.46 | Intron + ve, ASD > 4, Normals < 2, no Sanger filter applied | 6 |
| 18 | 48698719 | 48716663 | 17944 | gain | 1818 | DCC | 16.46 | Intron + ve, ASD > 4, Normals < 2, no Sanger filter applied | 6 |
| 18 | 18698719 | 48716663 | 17944 | gain | 1857 | DCC | 16.46 | Intron + ve, ASD > 4, Normals < 2, no Sanger filter applied | 6 |
| 18 | 48698719 | 48716663 | 17944 | gain | 2026 | DCC | 16.46 | Intron + ve, ASD > 4, Normals < 2, no Sanger filter applied | 6 |
| 18 | 48698719 | 48716663 | 17944 | gain | 1227 | DCC | 25.67 | Intron + ve, ASD > 4, Normals < 2, no Sanger filter applied | 6 |
| 18 | 48698719 | 48716663 | 17944 | gain | 1236 | DCC | 25.67 | Intron + ve, ASD > 4, Normals < 2, no Sanger filter applied | 6 |
| 18 | 48698719 | 48716663 | 17944 | gain | 1459 | DCC | 25.67 | Intron + ve, ASD > 4, Normals < 2, no Sanger filter applied | 6 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 18 | 48698719 | 48716663 | 17944 | gain | 1464 | DCC | 25.67 | Intron + ve, ASD > 4, Normals < 2, no Sanger filter applied | 6 |
| 18 | 48698719 | 48716663 | 17944 | gain | 1572 | DCC | 25.67 | Intron + ve, ASD > 4, Normals < 2, no Sanger filter applied | 6 |
| 18 | 48698719 | 48716663 | 17944 | gain | 1617 | DCC | 25.67 | Intron + ve, ASD > 4, Normals < 2, no Sanger filter applied | 6 |
| 18 | 48698719 | 48716663 | 17944 | gain | 1792 | DCC | 25.67 | Intron + ve, ASD > 4, Normals < 2, no Sanger filter applied | 6 |
| 18 | 48698719 | 48716663 | 17944 | gain | 1818 | DCC | 25.67 | Intron + ve, ASD > 4, Normals < 2, no Sanger filter applied | 6 |
| 18 | 48698719 | 48716663 | 17944 | gain | 1857 | DCC | 25.67 | Intron + ve, ASD > 4, Normals < 2, no Sanger filter applied | 6 |
| 18 | 48698719 | 48716663 | 17944 | gain | 2026 | DCC | 25.67 | Intron + ve, ASD > 4, Normals < 2, no Sanger filter applied | 6 |
| 18 | 48698719 | 48716663 | 17944 | gain | 1227 | DCC | 27.22 | Intron + ve, ASD > 4, Normals < 2, no Sanger filter applied | 6 |
| 18 | 48698719 | 48716663 | 17944 | gain | 1236 | DCC | 27.22 | Intron + ve, ASD > 4, Normals < 2, no Sanger filter applied | 6 |
| 18 | 48698719 | 48716663 | 17944 | gain | 1459 | DCC | 27.22 | Intron + ve, ASD > 4, Normals < 2, no Sanger filter applied | 6 |
| 18 | 48698719 | 48716663 | 17944 | gain | 1464 | DCC | 27.22 | Intron + ve, ASD > 4, Normals < 2, no Sanger filter applied | 6 |
| 18 | 48698719 | 48716663 | 17944 | gain | 1572 | DCC | 27.22 | Intron + ve, ASD > 4, Normals < 2, no Sanger filter applied | 6 |
| 18 | 48698719 | 48716663 | 17944 | gain | 1617 | DCC | 27.22 | Intron + ve, ASD > 4, Normals < 2, no Sanger filter applied | 6 |
| 18 | 48698719 | 48716663 | 17944 | gain | 1792 | DCC | 27.22 | Intron + ve, ASD > 4, Normals < 2, no Sanger filter applied | 6 |
| 18 | 48698719 | 48716663 | 17944 | gain | 1818 | DCC | 27.22 | Intron + ve, ASD > 4, Normals < 2, no Sanger filter applied | 6 |
| 18 | 48698719 | 48716663 | 17944 | gain | 1857 | DCC | 27.22 | Intron + ve, ASD > 4, Normals < 2, no Sanger filter applied | 6 |
| 18 | 48698719 | 48716663 | 17944 | gain | 2026 | DCC | 27.22 | Intron + ve, ASD > 4, Normals < 2, no Sanger filter applied | 6 |
| 18 | 48702422 | 48716663 | 14241 | gain | 1415 | DCC | 25.67 | Intron + ve, ASD > 4, Normals < 2, no Sanger filter applied | 224 |
| 18 | 48702422 | 48716663 | 14241 | gain | 1672 | DCC | 25.67 | Intron + ve, ASD > 4, Normals < 2, no Sanger filter applied | 224 |
| 18 | 48702422 | 48716663 | 14241 | gain | 1697 | DCC | 25.67 | Intron + ve, ASD > 4, Normals < 2, no Sanger filter applied | 224 |
| 18 | 48702422 | 48716663 | 14241 | gain | 1728 | DCC | 25.67 | Intron + ve, ASD > 4, Normals < 2, no Sanger filter applied | 221 |
| 18 | 48702422 | 48716663 | 14241 | gain | 1740 | DCC | 25.67 | Intron + ve, ASD > 4, Normals < 2, no Sanger filter applied | 224 |
| 18 | 48702422 | 48716663 | 14241 | gain | 1776 | DCC | 25.67 | Intron + ve, ASD > 4, Normals < 2, no Sanger filter applied | 224 |
| 18 | 48702422 | 48716663 | 14241 | gain | 1415 | DCC | 27.22 | Intron + ve, ASD > 4, Normals < 2, no Sanger filter applied | 224 |
| 18 | 48702422 | 48716663 | 14241 | gain | 1672 | DCC | 27.22 | Intron + ve, ASD > 4, Normals < 2, no Sanger filter applied | 224 |
| 18 | 48702422 | 48716663 | 14241 | gain | 1697 | DCC | 27.22 | Intron + ve, ASD > 4, Normals < 2, no Sanger filter applied | 224 |
| 18 | 48702422 | 48716663 | 14241 | gain | 1728 | DCC | 27.22 | Intron + ve, ASD > 4, Normals < 2, no Sanger filter applied | 224 |
| 18 | 48702422 | 48716663 | 14241 | gain | 1740 | DCC | 27.22 | Intron + ve, ASD > 4, Normals < 2, no Sanger filter applied | 224 |
| 18 | 48702422 | 48716663 | 14241 | gain | 1776 | DCC | 27.22 | Intron + ve, ASD > 4, Normals < 2, no Sanger filter applied | 224 |
| 18 | 48714802 | 48716663 | 1861 | gain | 1405 | DCC | 27.22 | Intron + ve, ASD > 4, Normals < 2, no Sanger filter applied | 223 |
| 18 | 65357415 | 65369843 | 12428 | loss | 1852 | DOK6 | 10.41 | Intron + ve, ASD > 4, Normals < 2, no Sanger filter applied | 428 |
| 18 | 65359770 | 65369843 | 10073 | loss | 1296 | DOK6 | 10.41 | Intron + ve, ASD > 4, Normals < 2, no Sanger filter applied | 427 |
| 18 | 65359770 | 65369843 | 10073 | loss | 1307 | DOK6 | 10.41 | Intron + ve, ASD > 4, Normals < 2, no Sanger filter applied | 427 |
| 18 | 65359770 | 65369843 | 10073 | loss | 1370 | DOK6 | 10.41 | Intron + ve, ASD > 4, Normals < 2, no Sanger filter applied | 427 |
| 18 | 65359770 | 65369843 | 10073 | loss | 1664 | DOK6 | 10.41 | Intron + ve, ASD > 4, Normals < 2, no Sanger filter applied | 427 |
| 18 | 65359770 | 65369843 | 10073 | loss | 1905 | DOK6 | 10.41 | Intron + ve, ASD > 4, Normals < 2, no Sanger filter applied | 427 |
| 18 | 65359770 | 65369843 | 10073 | loss | 1935 | DOK6 | 10.41 | Intron + ve, ASD > 4, Normals < 2, no Sanger filter applied | 427 |
| 18 | 65911512 | 65923901 | 12389 | loss | 1276 | RTTN | 8.91 | Genic (distinct CNV-subregions); OR > 6 | 493 |
| 18 | 65911512 | 65916736 | 5224 | loss | 1493 | RTTN | 8.91 | Genic (distinct CNV-subregions); OR > 6 | 494 |
| 18 | 65911512 | 65916736 | 5234 | loss | 1509 | RTTN | 8.91 | Genic (distinct CNV-subregions); OR > 6 | 494 |
| 18 | 65911512 | 65923901 | 12389 | loss | 1276 | RTTN | 8.91 | Genic (distinct CNV-subregions); OR > 6 | 493 |
| 18 | 65911512 | 65916736 | 5224 | loss | 1493 | RTTN | 8.91 | Genic (distinct CNV-subregions); OR > 6 | 494 |
| 18 | 65911512 | 65916736 | 5234 | loss | 1509 | RTTN | 8.91 | Genic (distinct CNV-subregions); OR > 6 | 494 |
| 18 | 65911512 | 65923901 | 12389 | loss | 1276 | RTTN | 8.91 | Genic (distinct CNV-subregions); OR > 6 | 493 |
| 18 | 65915539.39 | 65923901 | 8362 | loss | 1663 | RTTN | 8.91 | Genic (distinct CNV-subregions); OR > 6 | 495 |
| 18 | 65915539 | 65923901 | 8362 | loss | 1663 | RTTN | 8.91 | Genic (distinct CNV-subregions); OR > 6 | 495 |
| 18 | 65916736 | 65923901 | 7165 | loss | 1260 | RTTN | 8.91 | Genic (distinct CNV-subregions); OR > 6 | 496 |
| 18 | 65916736 | 65923901 | 7165 | loss | 1613 | RTTN | 8.91 | Genic (distinct CNV-subregions); OR > 6 | 196 |
| 19 | 241442 | 247531 | 6089 | loss | 1565 | PPAP2C | 4.44 | Exon + ve, 5 > ASD > 1, Normals < 2, Sanger − ve | 727 |
| 19 | 241442 | 247531 | 6089 | loss | 1567 | PPAP2C | 4.44 | Exon + ve, 5 > ASD > 1, Normals < 2, Sanger − ve | 727 |
| 19 | 241442 | 244260 | 2818 | loss | 1944 | PPAP2C | 4.44 | Exon + ve, 5 > ASD > 1, Normals < 2, Sanger − ve | 728 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 19 | 1200840 | 1202176 | 1336 | loss | 1224 | MIDN | 52.68 | Exon + ve, ASD > 4, Normals < 2, no Sanger filter applied | 1 |
| 19 | 1200840 | 1202176 | 1336 | loss | 1227 | MIDN | 52.68 | Exon + ve, ASD > 4, Normals < 2, no Sanger filter applied | 1 |
| 19 | 1200840 | 1221809 | 20969 | loss | 1230 | MIDN | 52.68 | Exon + ve, ASD > 4, Normals < 2, no Sanger filter applied | 1 |
| 19 | 1200840 | 1202176 | 1336 | gain | 1234 | MIDN | 52.68 | Exon + ve, ASD > 4, Normals < 2, no Sanger filter applied | 1 |
| 19 | 1200840 | 1202176 | 1336 | loss | 1301 | MIDN | 52.68 | Exon + ve, ASD > 4, Normals < 2, no Sanger filter applied | 1 |
| 19 | 1200840 | 1202176 | 1336 | loss | 1416 | MIDN | 52.68 | Exon + ve, ASD > 4, Normals < 2, no Sanger filter applied | 1 |
| 19 | 1200840 | 1202176 | 1336 | loss | 1471 | MIDN | 52.68 | Exon + ve, ASD > 4, Normals < 2, no Sanger filter applied | 1 |
| 19 | 1200840 | 1202176 | 1336 | loss | 1495 | MIDN | 52.68 | Exon + ve, ASD > 4, Normals < 2, no Sanger filter applied | 1 |
| 19 | 1200840 | 1202176 | 1336 | loss | 1503 | MIDN | 52.68 | Exon + ve, ASD > 4, Normals < 2, no Sanger filter applied | 1 |
| 19 | 1200840 | 1202176 | 1336 | loss | 1504 | MIDN | 52.68 | Exon + ve, ASD > 4, Normals < 2, no Sanger filter applied | 1 |
| 19 | 1200840 | 1202176 | 1336 | loss | 1520 | MIDN | 52.68 | Exon + ve, ASD > 4, Normals < 2, no Sanger filter applied | 1 |
| 19 | 1200840 | 1202176 | 1336 | loss | 1527 | MIDN | 52.68 | Exon + ve, ASD > 4, Normals < 2, no Sanger filter applied | 1 |
| 19 | 1200840 | 1202176 | 1336 | loss | 1528 | MIDN | 52.68 | Exon + ve, ASD > 4, Normals < 2, no Sanger filter applied | 1 |
| 19 | 1200840 | 1202176 | 1336 | loss | 1529 | MIDN | 52.68 | Exon + ve, ASD > 4, Normals < 2, no Sanger filter applied | 1 |
| 19 | 1200840 | 1202176 | 1336 | loss | 1532 | MIDN | 52.68 | Exon + ve, ASD > 4, Normals < 2, no Sanger filter applied | 1 |
| 19 | 1200840 | 1202176 | 1336 | loss | 1544 | MIDN | 52.68 | Exon + ve, ASD > 4, Normals < 2, no Sanger filter applied | 1 |
| 19 | 1200840 | 1202176 | 1336 | loss | 1566 | MIDN | 52.68 | Exon + ve, ASD > 4, Normals < 2, no Sanger filter applied | 1 |
| 19 | 1200840 | 1202176 | 1336 | loss | 1574 | MIDN | 52.68 | Exon + ve, ASD > 4, Normals < 2, no Sanger filter applied | 1 |
| 19 | 1200840 | 1202176 | 1336 | loss | 1577 | MIDN | 52.68 | Exon + ve, ASD > 4, Normals < 2, no Sanger filter applied | 1 |
| 19 | 1200840 | 1202176 | 1336 | loss | 1629 | MIDN | 52.68 | Exon + ve, ASD > 4, Normals < 2, no Sanger filter applied | 1 |
| 19 | 1200840 | 1202176 | 1336 | loss | 1672 | MIDN | 52.68 | Exon + ve, ASD > 4, Normals < 2, no Sanger filter applied | 1 |
| 19 | 1200840 | 1202176 | 1336 | loss | 1688 | MIDN | 52.68 | Exon + ve, ASD > 4, Normals < 2, no Sanger filter applied | 1 |
| 19 | 1200840 | 1202176 | 1336 | loss | 1724 | MIDN | 52.68 | Exon + ve, ASD > 4, Normals < 2, no Sanger filter applied | 1 |
| 19 | 1200840 | 1202176 | 1336 | loss | 1728 | MIDN | 52.68 | Exon + ve, ASD > 4, Normals < 2, no Sanger filter applied | 1 |
| 19 | 1200840 | 1202176 | 1336 | loss | 1742 | MIDN | 52.68 | Exon + ve, ASD > 4, Normals < 2, no Sanger filter applied | 1 |
| 19 | 1200840 | 1203447 | 2607 | loss | 1802 | MIDN | 52.68 | Exon + ve, ASD > 4, Normals < 2, no Sanger filter applied | 3 |
| 19 | 1200840 | 1202176 | 1336 | loss | 1827 | MIDN | 52.68 | Exon + ve, ASD > 4, Normals < 2, no Sanger filter applied | 1 |
| 19 | 1200840 | 1202176 | 1336 | loss | 1831 | MIDN | 52.68 | Exon + ve, ASD > 4, Normals < 2, no Sanger filter applied | 1 |
| 19 | 1200840 | 1202176 | 1336 | loss | 1870 | MIDN | 52.68 | Exon + ve, ASD > 4, Normals < 2, no Sanger filter applied | 1 |
| 19 | 1200840 | 1202176 | 1336 | loss | 1883 | MIDN | 52.68 | Exon + ve, ASD > 4, Normals < 2, no Sanger filter applied | 1 |
| 19 | 1200840 | 1203447 | 2607 | loss | 1921 | MIDN | 52.68 | Exon + ve, ASD > 4, Normals < 2, no Sanger filter applied | 3 |
| 19 | 1200840 | 1202176 | 1336 | loss | 1964 | MIDN | 52.68 | Exon + ve, ASD > 4, Normals < 2, no Sanger filter applied | 1 |
| 19 | 1200840 | 1202176 | 1336 | loss | 2018 | MIDN | 52.68 | Exon + ve, ASD > 4, Normals < 2, no Sanger filter applied | 1 |
| 19 | 1200840 | 1202176 | 1336 | loss | 2044 | MIDN | 52.68 | Exon + ve, ASD > 4, Normals < 2, no Sanger filter applied | 1 |
| 19 | 1398325 | 1400840 | 2515 | gain | 1258 | | 168.48 | high OR intergenic (OR > 30) | 64 |
| 19 | 1398325 | 1400840 | 2515 | gain | 1421 | | 168.48 | high OR intergenic (OR > 30) | 64 |
| 19 | 1398325 | 1400840 | 2515 | gain | 1637 | | 168.48 | high OR intergenic (OR > 30) | 64 |
| 19 | 1398325 | 1400840 | 2515 | gain | 1873 | | 168.48 | high OR intergenic (OR > 30) | 64 |
| 19 | 1398325 | 1400840 | 2515 | gain | 1926 | | 168.48 | high OR intergenic (OR > 30) | 64 |
| 19 | 1400798 | 1400840 | 42 | loss | 1229 | | 168.48 | high OR intergenic (OR > 30) | 63 |
| 19 | 1400798 | 1400840 | 12 | gain | 1236 | | 168.48 | high OR intergenic (OR > 30) | 63 |
| 19 | 1400798 | 1400840 | 42 | gain | 1238 | | 168.48 | high OR intergenic (OR > 30) | 63 |
| 19 | 1400798 | 1400840 | 42 | gain | 1239 | | 168.48 | high OR intergenic (OR > 30) | 63 |
| 19 | 1400798 | 1400840 | 42 | gain | 1240 | | 168.48 | high OR intergenic (OR > 30) | 63 |
| 19 | 1400798 | 1400840 | 42 | gain | 1245 | | 168.48 | high OR intergenic (OR > 30) | 63 |
| 19 | 1400798 | 1400840 | 12 | gain | 1259 | | 168.48 | high OR intergenic (OR > 30) | 63 |
| 19 | 1400798 | 1405308 | 4510 | gain | 1264 | | 168.48 | high OR intergenic (OR > 30) | 65 |
| 19 | 1400798 | 1400840 | 42 | gain | 1268 | | 168.48 | high OR intergenic (OR > 30) | 63 |
| 19 | 1400798 | 1400840 | 42 | gain | 1269 | | 168.48 | high OR intergenic (OR > 30) | 63 |
| 19 | 1400798 | 1400840 | 42 | gain | 1270 | | 168.48 | high OR intergenic (OR > 30) | 63 |
| 19 | 1400798 | 1400840 | 42 | gain | 1279 | | 168.48 | high OR intergenic (OR > 30) | 63 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 19 | 1400798 | 1400840 | 42 | gain | 1280 | | 168.48 | high OR intergenic (OR > 30) | 63 |
| 19 | 1400798 | 1400840 | 42 | gain | 1315 | | 168.48 | high OR intergenic (OR > 30) | 63 |
| 19 | 1400798 | 1400840 | 42 | gain | 1317 | | 168.48 | high OR intergenic (OR > 30) | 63 |
| 19 | 1400798 | 1400840 | 42 | gain | 1324 | | 168.48 | high OR intergenic (OR > 30) | 63 |
| 19 | 1400798 | 1400840 | 42 | loss | 1389 | | 168.48 | high OR intergenic (OR > 30) | 63 |
| 19 | 1400798 | 1400840 | 42 | gain | 1401 | | 168.48 | high OR intergenic (OR > 30) | 63 |
| 19 | 1400798 | 1400840 | 42 | gain | 1402 | | 168.48 | high OR intergenic (OR > 30) | 63 |
| 19 | 1400798 | 1400840 | 42 | gain | 1404 | | 168.48 | high OR intergenic (OR > 30) | 63 |
| 19 | 1400798 | 1400840 | 42 | gain | 1406 | | 168.48 | high OR intergenic (OR > 30) | 63 |
| 19 | 1400798 | 1400840 | 42 | loss | 1413 | | 168.48 | high OR intergenic (OR > 30) | 63 |
| 19 | 1400798 | 1400840 | 42 | loss | 1416 | | 168.48 | high OR intergenic (OR > 30) | 63 |
| 19 | 1400798 | 1400840 | 42 | gain | 1417 | | 168.48 | high OR intergenic (OR > 30) | 63 |
| 19 | 1400798 | 1400840 | 42 | gain | 1419 | | 168.48 | high OR intergenic (OR > 30) | 63 |
| 19 | 1400798 | 1400840 | 42 | gain | 1427 | | 168.48 | high OR intergenic (OR > 30) | 63 |
| 19 | 1400798 | 1400840 | 42 | gain | 1434 | | 168.48 | high OR intergenic (OR > 30) | 63 |
| 19 | 1400798 | 1400840 | 42 | loss | 1447 | | 168.48 | high OR intergenic (OR > 30) | 63 |
| 19 | 1400798 | 1400840 | 42 | loss | 1449 | | 168.48 | high OR intergenic (OR > 30) | 65 |
| 19 | 1400798 | 1400840 | 42 | loss | 1450 | | 168.48 | high OR intergenic (OR > 30) | 63 |
| 19 | 1400798 | 1400840 | 42 | loss | 1452 | | 168.48 | high OR intergenic (OR > 30) | 63 |
| 19 | 1400798 | 1400840 | 42 | loss | 1461 | | 168.48 | high OR intergenic (OR > 30) | 63 |
| 19 | 1400798 | 1400840 | 42 | loss | 1466 | | 168.48 | high OR intergenic (OR > 30) | 63 |
| 19 | 1400798 | 1400840 | 42 | loss | 1504 | | 168.48 | high OR intergenic (OR > 30) | 63 |
| 19 | 1400798 | 1400840 | 42 | loss | 1505 | | 168.48 | high OR intergenic (OR > 30) | 63 |
| 19 | 1400798 | 1400840 | 42 | gain | 1510 | | 168.48 | high OR intergenic (OR > 30) | 63 |
| 19 | 1400798 | 1400840 | 42 | loss | 1524 | | 168.48 | high OR intergenic (OR > 30) | 63 |
| 19 | 1400798 | 1400840 | 42 | loss | 1529 | | 168.48 | high OR intergenic (OR > 30) | 65 |
| 19 | 1400798 | 1400840 | 42 | gain | 1530 | | 168.48 | high OR intergenic (OR > 30) | 63 |
| 19 | 1400798 | 1400840 | 42 | gain | 1532 | | 168.48 | high OR intergenic (OR > 30) | 63 |
| 19 | 1400798 | 1400840 | 42 | gain | 1534 | | 168.48 | high OR intergenic (OR > 30) | 63 |
| 19 | 1400798 | 1400840 | 42 | gain | 1541 | | 168.48 | high OR intergenic (OR > 30) | 63 |
| 19 | 1400798 | 1400840 | 42 | gain | 1543 | | 168.48 | high OR intergenic (OR > 30) | 63 |
| 19 | 1400798 | 1400840 | 42 | loss | 1548 | | 168.48 | high OR intergenic (OR > 30) | 63 |
| 19 | 1400798 | 1400840 | 42 | loss | 1559 | | 168.48 | high OR intergenic (OR > 30) | 63 |
| 19 | 1400798 | 1400840 | 42 | gain | 1570 | | 168.48 | high OR intergenic (OR > 30) | 63 |
| 19 | 1400798 | 1400840 | 42 | loss | 1572 | | 168.48 | high OR intergenic (OR > 30) | 63 |
| 19 | 1400798 | 1400840 | 42 | loss | 1574 | | 168.48 | high OR intergenic (OR > 30) | 63 |
| 19 | 1400798 | 1400840 | 42 | gain | 1576 | | 168.48 | high OR intergenic (OR > 30) | 63 |
| 19 | 1400798 | 1400840 | 42 | gain | 1587 | | 168.48 | high OR intergenic (OR > 30) | 63 |
| 19 | 1400798 | 1400840 | 42 | gain | 1592 | | 168.48 | high OR intergenic (OR > 30) | 63 |
| 19 | 1400798 | 1400840 | 42 | gain | 1591 | | 168.48 | high OR intergenic (OR > 30) | 63 |
| 19 | 1400798 | 1400840 | 42 | gain | 1596 | | 168.48 | high OR intergenic (OR > 30) | 63 |
| 19 | 1400798 | 1400840 | 42 | gain | 1600 | | 168.48 | high OR intergenic (OR > 30) | 63 |
| 19 | 1400798 | 1400840 | 42 | gain | 1612 | | 168.48 | high OR intergenic (OR > 30) | 63 |
| 19 | 1400798 | 1400840 | 12 | gain | 1630 | | 168.48 | high OR intergenic (OR > 30) | 65 |
| 19 | 1400798 | 1400840 | 42 | gain | 1633 | | 168.48 | high OR intergenic (OR > 30) | 63 |
| 19 | 1400798 | 1400840 | 42 | gain | 1661 | | 168.48 | high OR intergenic (OR > 30) | 63 |
| 19 | 1400798 | 1400840 | 42 | loss | 1672 | | 168.48 | high OR intergenic (OR > 30) | 63 |
| 19 | 1400798 | 1400840 | 42 | loss | 1687 | | 168.48 | high OR intergenic (OR > 30) | 63 |
| 19 | 1400798 | 1400840 | 42 | loss | 1724 | | 168.48 | high OR intergenic (OR > 30) | 63 |
| 19 | 1400798 | 1400840 | 42 | gain | 1807 | | 168.48 | high OR intergenic (OR > 30) | 63 |
| 19 | 1400798 | 1400840 | 42 | loss | 1827 | | 168.48 | high OR intergenic (OR > 30) | 63 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 19 | 1400798 | 1400840 | 42 | loss | 1828 | | 168.48 | high OR intergenic (OR > 30) | 63 |
| 19 | 1400798 | 1400840 | 42 | loss | 1829 | | 168.48 | high OR intergenic (OR > 30) | 63 |
| 19 | 1400798 | 1400840 | 42 | loss | 1835 | | 168.48 | high OR intergenic (OR > 30) | 63 |
| 19 | 1400798 | 1400840 | 42 | gain | 1837 | | 168.48 | high OR intergenic (OR > 30) | 63 |
| 19 | 1400798 | 1400840 | 42 | gain | 1841 | | 168.48 | high OR intergenic (OR > 30) | 63 |
| 19 | 1400798 | 1400840 | 42 | gain | 1842 | | 168.48 | high OR intergenic (OR > 30) | 63 |
| 19 | 1400798 | 1400840 | 42 | gain | 1862 | | 168.48 | high OR intergenic (OR > 30) | 63 |
| 19 | 1400798 | 1400840 | 42 | gain | 1864 | | 168.48 | high OR intergenic (OR > 30) | 63 |
| 19 | 1400798 | 1400840 | 42 | gain | 1871 | | 168.48 | high OR intergenic (OR > 30) | 63 |
| 19 | 1400798 | 1400840 | 42 | loss | 1874 | | 168.48 | high OR intergenic (OR > 30) | 63 |
| 19 | 1400798 | 1400840 | 42 | gain | 1876 | | 168.48 | high OR intergenic (OR > 30) | 63 |
| 19 | 1400798 | 1400840 | 42 | loss | 1885 | | 168.48 | high OR intergenic (OR > 30) | 63 |
| 19 | 1400798 | 1400840 | 42 | gain | 1888 | | 168.48 | high OR intergenic (OR > 30) | 63 |
| 19 | 1400798 | 1400840 | 42 | gain | 1909 | | 168.48 | high OR intergenic (OR > 30) | 63 |
| 19 | 1400798 | 1400840 | 42 | loss | 1913 | | 168.48 | high OR intergenic (OR > 30) | 63 |
| 19 | 1400798 | 1400840 | 42 | loss | 1914 | | 168.48 | high OR intergenic (OR > 30) | 63 |
| 19 | 1400798 | 1400840 | 42 | gain | 1917 | | 168.48 | high OR intergenic (OR > 30) | 63 |
| 19 | 1400798 | 1400840 | 42 | gain | 1928 | | 168.48 | high OR intergenic (OR > 30) | 63 |
| 19 | 1400798 | 1400840 | 42 | gain | 1931 | | 168.48 | high OR intergenic (OR > 30) | 63 |
| 19 | 1400798 | 1400840 | 42 | loss | 1934 | | 168.48 | high OR intergenic (OR > 30) | 63 |
| 19 | 1400798 | 1400840 | 42 | gain | 1951 | | 168.48 | high OR intergenic (OR > 30) | 63 |
| 19 | 1400798 | 1400840 | 42 | loss | 1959 | | 168.48 | high OR intergenic (OR > 30) | 63 |
| 19 | 1400798 | 1400840 | 42 | loss | 1964 | | 168.48 | high OR intergenic (OR > 30) | 63 |
| 19 | 1400798 | 1400840 | 42 | gain | 2006 | | 168.48 | high OR intergenic (OR > 30) | 63 |
| 19 | 1400798 | 1400840 | 42 | gain | 2024 | | 168.48 | high OR intergenic (OR > 30) | 63 |
| 19 | 1400798 | 1400840 | 42 | gain | 2029 | | 168.48 | high OR intergenic (OR > 30) | 63 |
| 19 | 1400798 | 1400840 | 42 | gain | 2030 | | 168.48 | high OR intergenic (OR > 30) | 63 |
| 19 | 1400798 | 1400840 | 42 | gain | 2041 | | 168.48 | high OR intergenic (OR > 30) | 63 |
| 19 | 1400798 | 1400840 | 42 | gain | 2042 | | 168.48 | high OR intergenic (OR > 30) | 63 |
| 19 | 1400798 | 1400840 | 42 | loss | 2044 | | 168.48 | high OR intergenic (OR > 30) | 63 |
| 19 | 13083527 | 14014612 | 31085 | gain | 1461 | IL27RA, RLN3 | 2.95 | Exon + ve, 5 > ASD > 1, Normals < 2, Sanger − ve | 809 |
| 19 | 13983527 | 14014612 | 31085 | gain | 1878 | IL27RA, RLN3 | 2.95 | Exon + ve, 5 > ASD > 1, Normals < 2, Sanger − ve | 809 |
| 19 | 19944096 | 20517399 | 573303 | loss | 1918 | ZNF486 | 2.95 | Exon + ve, 5 > ASD > 1, Normals < 2, Sanger − ve | 657 |
| 19 | 19944096 | 20517399 | 573503 | loss | 1918 | ZNF486 | 5.92 | Exon + ve, 5 > ASD > 1, Normals < 2, Sanger − ve | 657 |
| 19 | 20115129 | 20270725 | 155596 | loss | 1577 | ZNF737 | 2.95 | Exon + ve, 5 > ASD > 1, Normals < 2, Sanger − ve | 810 |
| 19 | 20083210 | 20223643 | 140433 | loss | 1416 | ZNF737 | 5.92 | Exon + ve, 5 > ASD > 1, Normals < 2, Sanger − ve | 656 |
| 19 | 20425020 | 20517399 | 92379 | loss | 1333 | ZNF737 | 5.93 | Exon + ve, 5 > ASD > 1, Normals < 2, Sanger − ve | 655 |
| 19 | 20425020 | 20517399 | 92379 | loss | 1781 | ZNF737 | 5.92 | Exon + ve, 5 > ASD > 1, Normals < 2, Sanger − ve | 655 |
| 19 | 23776705 | 23805817 | 29022 | gain | 1783 | RPSAP58 | 17.98 | Intron + ve, ASD > 4, Normals < 2, no Sanger filter applied | 256 |
| 19 | 23776795 | 23805817 | 29022 | gain | 1783 | RPSAP58 | 13.43 | Intron + ve, ASD > 4, Normals < 2, no Sanger filter applied | 256 |
| 19 | 23785986 | 23800104 | 14118 | loss | 1525 | RPSAP58 | 17.98 | Intron + ve, ASD > 4, Normals < 2, no Sanger filter applied | 252 |
| 19 | 23785986 | 23800104 | 14118 | gain | 1587 | RPSAP58 | 17.98 | Intron + ve, ASD > 4, Normals < 2, no Sanger filter applied | 252 |
| 19 | 23785986 | 23800104 | 14118 | gain | 1323 | RPSAP58 | 13.43 | Intron + ve, ASD > 4, Normals < 2, no Sanger filter applied | 252 |
| 19 | 23786448 | 23800104 | 13656 | gain | 1587 | RPSAP58 | 17.98 | Intron + ve, ASD > 4, Normals < 2, no Sanger filter applied | 252 |
| 19 | 23786448 | 23800104 | 13656 | gain | 1509 | RPSAP58 | 13.43 | Intron + ve, ASD > 4, Normals < 2, no Sanger filter applied | 253 |
| 19 | 23786448 | 23804481 | 18033 | gain | 1541 | RPSAP58 | 17.98 | Intron + ve, ASD > 4, Normals < 2, no Sanger filter applied | 254 |
| 19 | 23786448 | 23800104 | 13656 | gain | 1585 | RPSAP58 | 17.98 | Intron + ve, ASD > 4, Normals < 2, no Sanger filter applied | 253 |
| 19 | 23786448 | 23800104 | 13656 | gain | 1606 | RPSAP58 | 17.98 | Intron + ve, ASD > 4, Normals < 2, no Sanger filter applied | 253 |
| 19 | 23786448 | 23804481 | 18033 | gain | 1608 | RPSAP58 | 17.98 | Intron + ve, ASD > 4, Normals < 2, no Sanger filter applied | 254 |
| 19 | 23786448 | 23800104 | 13656 | gain | 1612 | RPSAP58 | 17.98 | Intron + ve, ASD > 4, Normals < 2, no Sanger filter applied | 253 |
| 19 | 23786448 | 23790608 | 4160 | gain | 1775 | RPSAP58 | 17.98 | Intron + ve, ASD > 4, Normals < 2, no Sanger filter applied | 255 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 19 | 23786448 | 23790608 | 4160 | gain | 1777 | RPSAP58 | 17.98 | Intron + ve, ASD > 4, Normals < 2, no Sanger filter applied | 255 |
| 19 | 23786448 | 23790608 | 4160 | gain | 2041 | RPSAP58 | 17.98 | Intron + ve, ASD > 4, Normals < 2, no Sanger filter applied | 255 |
| 19 | 23786448 | 23800104 | 13656 | gain | 1509 | RPSAP58 | 13.43 | Intron + ve, ASD > 4, Normals < 2, no Sanger filter applied | 253 |
| 19 | 23786448 | 23804481 | 18033 | gain | 1541 | RPSAP58 | 13.43 | Intron + ve, ASD > 4, Normals < 2, no Sanger filter applied | 254 |
| 19 | 23786448 | 23800104 | 13656 | gain | 1585 | RPSAP58 | 13.43 | Intron + ve, ASD > 4, Normals < 2, no Sanger filter applied | 253 |
| 19 | 23786448 | 23800104 | 13656 | gain | 1606 | RPSAP58 | 13.43 | Intron + ve, ASD > 4, Normals < 2, no Sanger filter applied | 253 |
| 19 | 23786448 | 23804481 | 18033 | gain | 1608 | RPSAP58 | 13.43 | Intron + ve, ASD > 4, Normals < 2, no Sanger filter applied | 254 |
| 19 | 23786448 | 23800104 | 13656 | gain | 1612 | RPSAP58 | 13.43 | Intron + ve, ASD > 4, Normals < 2, no Sanger filter applied | 253 |
| 19 | 42530955 | 42537766 | 6811 | loss | 1348 | HKR1 | 7.42 | Intron + ve, ASD > 4, Normals < 2, no Sanger filter applied | 381 |
| 19 | 42530955 | 42537766 | 6811 | loss | 1459 | HKR1 | 7.42 | Intron + ve, ASD > 4, Normals < 2, no Sanger filter applied | 381 |
| 19 | 42530955 | 42537766 | 6811 | loss | 1684 | HKR1 | 7.42 | Intron + ve, ASD > 4, Normals < 2, no Sanger filter applied | 381 |
| 19 | 42530955 | 42537766 | 6811 | loss | 1816 | HKR1 | 7.42 | Intron + ve, ASD > 4, Normals < 2, no Sanger filter applied | 381 |
| 19 | 42530955 | 42537766 | 6811 | loss | 2021 | HKR1 | 7.42 | Intron + ve, ASD > 4, Normals < 2, no Sanger filter applied | 381 |
| 19 | 42530955 | 42537766 | 6811 | loss | 1348 | HKR1 | 11.92 | Intron + ve, ASD > 4, Normals < 2, no Sanger filter applied | 381 |
| 19 | 42530955 | 42537766 | 6811 | loss | 1459 | HKR1 | 11.92 | Intron + ve, ASD > 4, Normals < 2, no Sanger filter applied | 381 |
| 19 | 42530955 | 42537766 | 6811 | loss | 1684 | HKR1 | 11.92 | Intron + ve, ASD > 4, Normals < 2, no Sanger filter applied | 381 |
| 19 | 42530955 | 42537766 | 6811 | loss | 1816 | HKR1 | 11.92 | Intron + ve, ASD > 4, Normals < 2, no Sanger filter applied | 381 |
| 19 | 42530955 | 42537766 | 6811 | loss | 2024 | HKR1 | 11.92 | Intron + ve, ASD > 4, Normals < 2, no Sanger filter applied | 381 |
| 19 | 42537228 | 42537766 | 538 | loss | 1402 | HKR1 | 11.92 | Intron + ve, ASD > 4, Normals < 2, no Sanger filter applied | 382 |
| 19 | 42537228 | 42537766 | 538 | loss | 1528 | HKR1 | 11.92 | Intron + ve, ASD > 4, Normals < 2, no Sanger filter applied | 382 |
| 19 | 42537228 | 42537766 | 538 | loss | 1658 | HKR1 | 11.92 | Intron + ve, ASD > 4, Normals < 2, no Sanger filter applied | 382 |
| 19 | 46032427 | 46089262 | 56835 | gain | 1229 | CYP2A6 | 7.42 | Exon + ve, ASD > 4, Normals < 2, no Sanger filter applied | 611 |
| 19 | 46032427 | 46063357 | 30930 | gain | 1395 | CYP2A6 | 7.42 | Exon + ve, ASD > 4, Normals < 2, no Sanger filter applied | 612 |
| 19 | 46032427 | 46060523 | 28096 | gain | 1538 | CYP2A6 | 7.42 | Exon + ve, ASD > 4, Normals < 2, no Sanger filter applied | 613 |
| 19 | 46032427 | 46063357 | 30930 | gain | 1869 | CYP2A6 | 7.42 | Exon + ve, ASD > 4, Normals < 2, no Sanger filter applied | 612 |
| 19 | 46032427 | 46063357 | 30930 | gain | 2020 | CYP2A6 | 7.42 | Exon + ve, ASD > 4, Normals < 2, no Sanger filter applied | 612 |
| 19 | 48494496 | 48575260 | 80764 | loss | 1786 | CD177, PRG1 | 2.95 | Exon + ve, 5 > ASD > 1, Normals < 2, Sanger – ve | 812 |
| 19 | 48494496 | 48551450 | 56954 | loss | 1899 | CD177, PRG1 | 2.95 | Exon + ve, 5 > ASD > 1, Normals < 2, Sanger – ve | 812 |
| 19 | 52215524 | 52339852 | 24328 | gain | 1393 | SAR1 | 5.92 | Exon + ve, 5 > ASD > 1, Normals < 2, Sanger – ve | 658 |
| 19 | 52215524 | 52339852 | 24328 | gain | 1514 | SAR1 | 5.92 | Exon + ve, 5 > ASD > 1, Normals < 2, Sanger – ve | 658 |
| 19 | 52315524 | 52365982 | 50458 | gain | 1871 | SAR1 | 5.92 | Exon + ve, 5 > ASD > 1, Normals < 2, Sanger – ve | 659 |
| 19 | 52315524 | 52339852 | 24328 | gain | 1954 | SAR1 | 5.92 | Exon + ve, 5 > ASD > 1, Normals < 2, Sanger – ve | 658 |
| 19 | 57885454 | 58252109 | 366655 | gain | 1646 | HERV-V1 | 8.98 | Genic (distinct CNV-subregions); OR > 6 | 436 |
| 19 | 58201323 | 58244012 | 42689 | gain | 1786 | HERV-V1 | 8.98 | Genic (distinct CNV-subregions); OR > 6 | 438 |
| 19 | 58206232 | 58244012 | 37780 | gain | 1649 | HERV-V1 | 8.98 | Genic (distinct CNV-subregions); OR > 6 | 437 |
| 19 | 58208527 | 58244012 | 35185 | gain | 1287 | HERV-V1 | 8.98 | Genic (distinct CNV-subregions); OR > 6 | 435 |
| 19 | 58208527 | 58244012 | 35485 | gain | 1337 | HERV-V1 | 8.98 | Genic (distinct CNV-subregions); OR > 6 | 435 |
| 19 | 58208527 | 58244012 | 35485 | gain | 1348 | HERV-V1 | 8.98 | Genic (distinct CNV-subregions); OR > 6 | 435 |
| 19 | 58208527 | 58244012 | 35485 | gain | 1424 | HERV-V1 | 8.98 | Genic (distinct CNV-subregions); OR > 6 | 435 |
| 19 | 58208527 | 58244012 | 35485 | gain | 1458 | HERV-V1 | 8.98 | Genic (distinct CNV-subregions); OR > 6 | 435 |
| 19 | 58208527 | 58244012 | 35485 | gain | 1505 | HERV-V1 | 8.98 | Genic (distinct CNV-subregions); OR > 6 | 435 |
| 19 | 58208527 | 58244012 | 35485 | gain | 1511 | HERV-V1 | 8.98 | Genic (distinct CNV-subregions); OR > 6 | 435 |
| 19 | 58208527 | 58244012 | 35485 | gain | 1529 | HERV-V1 | 8.98 | Genic (distinct CNV-subregions); OR > 6 | 435 |
| 19 | 58208527 | 58244012 | 35485 | gain | 1633 | HERV-V1 | 8.98 | Genic (distinct CNV-subregions); OR > 6 | 435 |
| 19 | 58910511 | 58923614 | 13103 | gain | 1606 | MIR516B2, MIR526A2 | 4.44 | Exon + ve, 5 > ASD > 1, Normals < 2, Sanger – ve | 729 |
| 19 | 58920523 | 58927377 | 6854 | gain | 1914 | MIR516B2, MIR526A2 | 4.44 | Exon + ve, 5 > ASD > 1, Normals < 2, Sanger – ve | 730 |
| 19 | 58920523 | 58927377 | 6854 | gain | 1966 | MIR516B2, MIR526A2 | 4.44 | Exon + ve, 5 > ASD > 1, Normals < 2, Sanger – ve | 730 |
| 19 | 58920523 | 58927377 | 6854 | gain | 1914 | MIR518A1, MIR518E | 2.95 | Exon + ve, 5 > ASD > 1, Normals < 2, Sanger – ve | 730 |
| 19 | 58920523 | 58927377 | 6854 | gain | 1966 | MIR518A1, MIR518E | 2.95 | Exon + ve, 5 > ASD > 1, Normals < 2, Sanger – ve | 730 |
| 19 | 59403499 | 59440262 | 36763 | loss | 2006 | LILRB3 | 14.94 | Exon + ve, ASD > 4, Normals < 2, no Sanger filter applied | 26 |
| 19 | 59404710 | 59434202 | 29492 | loss | 1804 | LILRB3 | 14.94 | Exon + ve, ASD > 4, Normals < 2, no Sanger filter applied | 25 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 19 | 59406523 | 59440262 | 33739 | loss | 1429 | LILRB3 | 14.94 | Exon + ve, ASD > 4, Normals < 2, no Sanger filter applied | 22 |
| 19 | 59406523 | 59440274 | 33751 | loss | 1803 | LILRB3 | 14.94 | Exon + ve, ASD > 4, Normals < 2, no Sanger filter applied | 24 |
| 19 | 59406523 | 59440262 | 33739 | loss | 1875 | LILRB3 | 14.94 | Exon + ve, ASD > 4, Normals < 2, no Sanger filter applied | 22 |
| 19 | 59410642 | 59434202 | 23560 | loss | 1230 | LILRB3 | 14.94 | Exon + ve, ASD > 4, Normals < 2, no Sanger filter applied | 20 |
| 19 | 59410642 | 59434159 | 23517 | loss | 1346 | LILRB3 | 14.94 | Exon + ve, ASD > 4, Normals < 2, no Sanger filter applied | 20 |
| 19 | 59410642 | 59434202 | 23560 | loss | 1392 | LILRB3 | 14.94 | Exon + ve, ASD > 4, Normals < 2, no Sanger filter applied | 21 |
| 19 | 59410642 | 59434202 | 23560 | loss | 1616 | LILRB3 | 14.94 | Exon + ve, ASD > 4, Normals < 2, no Sanger filter applied | 20 |
| 19 | 59411618 | 59440274 | 28656 | loss | 1635 | LILRB3 | 14.94 | Exon + ve, ASD > 4, Normals < 2, no Sanger filter applied | 23 |
| 19 | 59840242 | 59869388 | 29146 | gain | 1751 | LILRB4 | 2.95 | Exon + ve, 5 > ASD > 1, Normals < 2, Sanger − ve | 814 |
| 19 | 59864456 | 59865970 | 1514 | loss | 1627 | LILRB4 | 2.95 | Exon + ve, 5 > ASD > 1, Normals < 2, Sanger − ve | 813 |
| 19 | 63483128 | 63704294 | 221166 | gain | 1862 | SLC27A5 | 2.95 | Exon + ve, 5 > ASD > 1, Normals < 2, Sanger − ve | 816 |
| 19 | 63694462 | 63718171 | 23709 | gain | 1571 | SLC27A5 | 2.95 | Exon + ve, 5 > ASD > 1, Normals < 2, Sanger − ve | 815 |
| 20 | 1511632 | 1546858 | 35226 | gain | 1298 | SIRPB1 | 7.42 | Intron + ve, ASD > 4, Normals < 2, no Sanger filter applied | 614 |
| 20 | 1511632 | 1546858 | 35226 | gain | 1449 | SIRPB1 | 7.42 | Intron + ve, ASD > 4, Normals < 2, no Sanger filter applied | 614 |
| 20 | 1511632 | 1548251 | 36619 | gain | 1722 | SIRPB1 | 7.42 | Intron + ve, ASD > 4, Normals < 2, no Sanger filter applied | 616 |
| 20 | 1511632 | 1548251 | 36619 | gain | 1935 | SIRPB1 | 7.42 | Intron + ve, ASD > 4, Normals < 2, no Sanger filter applied | 616 |
| 20 | 1544485 | 1820899 | 276414 | gain | 1473 | SIRPB1 | 7.42 | Intron + ve, ASD > 4, Normals < 2, no Sanger filter applied | 615 |
| 20 | 26080750 | 28252024 | 2171274 | loss | 1694 | FRG1B | 14.94 | Exon + ve, ASD > 4, Normals < 2, no Sanger filter applied | 18 |
| 20 | 26148764 | 28250082 | 2101318 | gain | 1392 | FRG1B | 14.94 | Exon + ve, ASD > 4, Normals < 2, no Sanger filter applied | 15 |
| 20 | 26148764 | 28252024 | 2103260 | gain | 1429 | FRG1B | 14.94 | Exon + ve, ASD > 4, Normals < 2, no Sanger filter applied | 17 |
| 20 | 26148764 | 28252024 | 2103260 | gain | 1571 | FRG1B | 14.94 | Exon + ve, ASD > 4, Normals < 2, no Sanger filter applied | 17 |
| 20 | 26148764 | 28252024 | 2103260 | gain | 1875 | FRG1B | 14.94 | Exon + ve, ASD > 4, Normals < 2, no Sanger filter applied | 17 |
| 20 | 26173123 | 28266113 | 2092990 | gain | 1285 | FRG1B | 14.94 | Exon + ve, ASD > 4, Normals < 2, no Sanger filter applied | 14 |
| 20 | 26173123 | 28266113 | 2092990 | gain | 1401 | FRG1B | 14.94 | Exon + ve, ASD > 4, Normals < 2, no Sanger filter applied | 14 |
| 20 | 26173123 | 28252024 | 2078901 | gain | 1405 | FRG1B | 14.94 | Exon + ve, ASD > 4, Normals < 2, no Sanger filter applied | 16 |
| 20 | 26173123 | 28252024 | 2078901 | gain | 1422 | FRG1B | 14.94 | Exon + ve, ASD > 4, Normals < 2, no Sanger filter applied | 16 |
| 20 | 26173123 | 28250082 | 2076959 | gain | 1865 | FRG1B | 14.94 | Exon + ve, ASD > 4, Normals < 2, no Sanger filter applied | 19 |
| 20 | 45214150 | 45220204 | 6045 | loss | 1471 | EYA2 | 10.41 | Intron + ve, ASD > 4, Normals < 2, no Sanger filter applied | 429 |
| 20 | 45214159 | 45220204 | 6045 | loss | 1533 | EYA2 | 10.41 | Intron + ve, ASD > 4, Normals < 2, no Sanger filter applied | 429 |
| 20 | 45214159 | 45220204 | 6045 | loss | 1572 | EYA2 | 10.41 | Intron + ve, ASD > 4, Normals < 2, no Sanger filter applied | 429 |
| 20 | 45214159 | 45220204 | 6045 | loss | 1632 | EYA2 | 10.41 | Intron + ve, ASD > 4, Normals < 2, no Sanger filter applied | 429 |
| 20 | 45214159 | 45220204 | 6045 | loss | 1734 | EYA2 | 10.41 | Intron + ve, ASD > 4, Normals < 2, no Sanger filter applied | 429 |
| 20 | 45214159 | 45220204 | 6045 | loss | 1742 | EYA2 | 10.41 | Intron + ve, ASD > 4, Normals < 2, no Sanger filter applied | 429 |
| 20 | 45214159 | 45220204 | 6015 | loss | 1742 | EYA2 | 10.41 | Intron + ve, ASD > 4, Normals < 2, no Sanger filter applied | 429 |
| 20 | 52081719 | 52092989 | 11270 | loss | 1472 | BCAS1 | 8.91 | Intron + ve, ASD > 4, Normals < 2, no Sanger filter applied | 497 |
| 20 | 52081719 | 52092989 | 11270 | loss | 1490 | BCAS1 | 8.91 | Intron + ve, ASD > 4, Normals < 2, no Sanger filter applied | 497 |
| 20 | 52081719 | 52092989 | 11270 | loss | 1595 | BCAS1 | 8.91 | Intron + ve, ASD > 4, Normals < 2, no Sanger filter applied | 497 |
| 20 | 52081719 | 52092989 | 11270 | loss | 1721 | BCAS1 | 8.91 | Intron + ve, ASD > 4, Normals < 2, no Sanger filter applied | 497 |
| 20 | 52081719 | 52092989 | 11270 | loss | 1876 | BCAS1 | 8.91 | Intron + ve, ASD > 4, Normals < 2, no Sanger filter applied | 497 |
| 20 | 52081719 | 52092989 | 11270 | loss | 2043 | BCAS1 | 8.91 | Intron + ve, ASD > 4, Normals < 2, no Sanger filter applied | 497 |
| 20 | 60949338 | 62419534 | 1470196 | gain | 1699 | LOC63930 | 4.44 | Exon + ve, 5 > ASD > 1, Normals < 2, Sanger − ve | 499 |
| 20 | 60949338 | 62419534 | 1470196 | gain | 1699 | LOC63930, NCRNA00029 | 4.44 | Exon + ve, 5 > ASD > 1, Normals < 2, Sanger − ve | 499 |
| 20 | 60949338 | 62419534 | 1470196 | gain | 1699 | HAR1B, HAR1A | 8.91 | Exon + ve, ASD > 4, Normals < 2, no Sanger filter applied | 499 |
| 20 | 61130661 | 61131984 | 1323 | loss | 1625 | LOC63930 | 7.42 | Intron + ve, ASD > 4, Normals < 2, no Sanger filter applied | 617 |
| 20 | 61130661 | 61136457 | 5796 | loss | 1773 | LOC63930 | 7.42 | Intron + ve, ASD > 4, Normals < 2, no Sanger filter applied | 618 |
| 20 | 61130661 | 61136457 | 5796 | loss | 1821 | LOC63930 | 7.42 | Intron + ve, ASD > 4, Normals < 2, no Sanger filter applied | 618 |
| 20 | 61131984 | 61136457 | 1323 | loss | 1886 | LOC63930 | 7.42 | Intron + ve, ASD > 4, Normals < 2, no Sanger filter applied | 617 |
| 20 | 61130661 | 61136457 | 5796 | loss | 1773 | LOC63930, NCRNA00029 | 4.44 | Exon + ve, 5 > ASD > 1, Normals < 2, Sanger − ve | 618 |
| 20 | 61130661 | 61136457 | 5796 | loss | 1821 | LOC63930, NCRNA00029 | 4.44 | Exon + ve, 5 > ASD > 1, Normals < 2, Sanger − ve | 618 |
| 20 | 61195158 | 61204000 | 8842 | gain | 1262 | HAR1B, HAR1A | 8.91 | Exon + ve, ASD > 4, Normals < 2, no Sanger filter applied | 498 |
| 20 | 61195158 | 61204000 | 8842 | gain | 1324 | HAR1B, HAR1A | 8.91 | Exon + ve, ASD > 4, Normals < 2, no Sanger filter applied | 498 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 20 | 61195158 | 61204000 | 8842 | gain | 1541 | HAR1B, HAR1A | 8.91 | Exon + ve, ASD > 4, Normals < 2, no Sanger filter applied | 498 |
| 20 | 61195158 | 61204000 | 8842 | gain | 1542 | HAR1B, HAR1A | 8.91 | Exon + ve, ASD > 4, Normals < 2, no Sanger filter applied | 498 |
| 20 | 61195158 | 61204000 | 8842 | gain | 1591 | HAR1B, HAR1A | 8.91 | Exon + ve, ASD > 4, Normals < 2, no Sanger filter applied | 498 |
| 21 | 46514488 | 46679302 | 164814 | gain | 1430 | C21orf58, PCNT | 2.95 | Exon + ve, 5 > ASD > 1, Normals < 2, Sanger – ve | 817 |
| 21 | 46514488 | 46679302 | 164814 | gain | 1730 | PCNT | 2.95 | Exon + ve, 5 > ASD > 1, Normals < 2, Sanger – ve | 817 |
| 21 | 46659453 | 46699682 | 40229 | gain | 1430 | C21orf58, PCNT | 2.95 | Exon + ve, 5 > ASD > 1, Normals < 2, Sanger – ve | 818 |
| 21 | 46657906 | 46674328 | 16422 | gain | 1953 | PCNT | 2.95 | Exon + ve, 5 > ASD > 1, Normals < 2, Sanger – ve | 819 |
| 22 | 17031614 | 19794060 | 2762446 | gain | 1753 | DGCR11, DGCR2 | 4.44 | Exon + ve, 5 > ASD > 1, Normals < 2, Sanger – ve | 260 |
| 22 | 17031614 | 18125356 | 1093742 | gain | 1844 | DGCR11, DGCR2 | 4.44 | Exon + ve, 5 > ASD > 1, Normals < 2, Sanger – ve | 501 |
| 22 | 17031614 | 19794060 | 2762446 | gain | 1753 | DGCR2 | 8.91 | Exon + ve, ASD > 4, Normals < 2, no Sanger filter applied | 260 |
| 22 | 17031614 | 18125356 | 1093742 | gain | 1844 | DGCR2 | 8.91 | Exon + ve, ASD > 4, Normals < 2, no Sanger Filter applied | 501 |
| 22 | 17031614 | 19794060 | 2762446 | gain | 1753 | DGCR2, TSSK2, DGCR14 | 4.44 | Exon + ve, 5 > ASD > 1, Normals < 2, Sanger – ve | 260 |
| 22 | 17031614 | 18125356 | 1093742 | gain | 1844 | DGCR2, TSSK2, DGCR14 | 4.44 | Exon + ve, 5 > ASD > 1, Normals < 2, Sanger – ve | 501 |
| 22 | 17031614 | 19794060 | 2762446 | gain | 1753 | CLTCL1, SLC25A1, GSC2 | 4.44 | Exon + ve, 5 > ASD > 1, Normals < 2, Sanger – ve | 260 |
| 22 | 17031614 | 18125356 | 1093742 | gain | 1844 | CLTCL1, SLC25A1, GSC2 | 4.44 | Exon + ve, 5 > ASD > 1, Normals < 2, Sanger – ve | 501 |
| 22 | 17031614 | 19794060 | 2762446 | gain | 1753 | CLTCL1 | 4.44 | Exon + ve, 5 > ASD > 1, Normals < 2, Sanger – ve | 260 |
| 22 | 17031614 | 18125356 | 1093742 | gain | 1844 | CLTCL1 | 4.44 | Exon + ve, 5 > ASD > 1, Normals < 2, Sanger – ve | 501 |
| 22 | 17031614 | 19794060 | 2762446 | gain | 1753 | CLTCL1 | 4.44 | Exon + ve, 5 > ASD > 1, Normals < 2, Sanger – ve | 260 |
| 22 | 17031614 | 10704060 | 1093742 | gain | 1753 | HIRA, CLDN5, C22orf39, MRPL40, LOC150185, CDC45, UFD1L | 4.44 | Exon + ve, 5 > ASD > 1, Normals < 2, Sanger – ve | 260 |
| 22 | 17031614 | 18125356 | 1093742 | gain | 1844 | HIRA, CLDN5, C22orf39, MRPL40, LOC150185, CDC45, UFD1L | 4.44 | Exon + ve, 5 > ASD > 1, Normals < 2, Sanger – ve | 501 |
| 22 | 17031614 | 10704060 | 2762446 | gain | 1753 | SEPT5, GP1BB, SEPT5-GP1BB | 4.44 | Exon + ve, 5 > ASD > 1, Normals < 2, Sanger – ve | 260 |
| 22 | 17031614 | 18125356 | 1093742 | gain | 1844 | SEPT5, GP1BB, SEPT5-GP1BB | 4.44 | Exon + ve, 5 > ASD > 1, Normals < 2, Sanger – ve | 501 |
| 22 | 17031614 | 19794060 | 2762446 | gain | 1753 | GP1BB, SEPT5-GP1BB | 7.42 | Exon + ve, ASD > 4, Normals < 2, no Sanger filter applied | 260 |
| 22 | 17031614 | 18125356 | 1093742 | gain | 1844 | GP1BB, SEPT5-GP1BB | 7.42 | Exon + ve, ASD > 4, Normals < 2, no Sanger filter applied | 501 |
| 22 | 17031614 | 19794060 | 2762446 | gain | 1753 | TBX1 | 5.92 | Exon + ve, 5 > ASD > 1, Normals < 2, Sanger – ve | 260 |
| 22 | 17031614 | 18125356 | 1093742 | gain | 1844 | TBX1 | 5.92 | Exon + ve, 5 > ASD > 1, Normals < 2, Sanger – ve | 501 |
| 22 | 17031614 | 19794060 | 2762446 | gain | 1753 | TBX1 | 4.44 | Exon + ve, 5 > ASD > 1, Normals < 2, Sanger – ve | 260 |
| 22 | 17031614 | 19794060 | 2762446 | gain | 1753 | GNB1L, TBX1 | 4.44 | Exon + ve, 5 > ASD > 1, Normals < 2, Sanger – ve | 260 |
| 22 | 17031614 | 19794060 | 2762446 | gain | 1753 | ARVCF, MIR185, C22orf29, COMT, GNB1L, TXNRD2, C22orf25 | 4.44 | Exon + ve, 5 > ASD > 1, Normals < 2, Sanger – ve | 260 |
| 22 | 17031614 | 19794060 | 2762446 | gain | 1753 | DGCR8, ZDHHC8, MIR3618, TRMT2A, MIR1306, RANBP1, C22orf25 | 4.44 | Exon + ve, 5 > ASD > 1, Normals < 2, Sanger – ve | 260 |
| 22 | 17031614 | 19794060 | 2762446 | gain | 1753 | ZDHHC8 | 7.42 | Intron + ve, ASD > 4, Normals < 2, no Sanger filter applied | 260 |
| 22 | 17031614 | 19794060 | 2762446 | gain | 1753 | ZDHHC8 | 11.92 | Exon + ve, ASD > 4, Normals < 2, no Sanger filter applied | 501 |
| 22 | 17031614 | 19794060 | 2762446 | gain | 1753 | ZDHHC8 | 17.98 | Exon + ve, ASD > 4, Normals < 2, no Sanger filter applied | 260 |
| 22 | 17031614 | 19794060 | 2762446 | gain | 1753 | ZDHHC8 | 5.92 | Exon + ve, 5 > ASD > 1, Normals < 2, Sanger – ve | 260 |
| 22 | 17031614 | 19794060 | 2762446 | gain | 1753 | SERPIND1, PI4KA | 4.44 | Exon + ve, 5 > ASD > 1, Normals < 2, Sanger – ve | 260 |
| 22 | 17031614 | 19794060 | 2762446 | gain | 1753 | CRKL, SNAP29, PI4KA | 8.91 | Intron + ve, ASD > 4, Normals < 2, no Sanger filter applied | 260 |
| 22 | 17031614 | 19794060 | 2762446 | gain | 1753 | CRKL | 5.92 | Exon + ve, 5 > ASD > 1, Normals < 2, Sanger – ve | 260 |
| 22 | 17031614 | 19794060 | 2762446 | gain | 1753 | CRKL | 4.44 | Exon + ve, 5 > ASD > 1, Normals < 2, Sanger – ve | 260 |
| 22 | 17274339 | 20141979 | 2867640 | gain | 1490 | DGCR11, DGCR2 | 4.44 | Exon + ve, 5 > ASD > 1, Normals < 2, Sanger – ve | 260 |
| 22 | 17274339 | 20141979 | 2867640 | gain | 1490 | DGCR2 | 8.91 | Exon + ve, ASD > 4, Normals < 2, no Sanger filter applied | 258 |
| 22 | 17274339 | 20141979 | 2867640 | gain | 1490 | DGCR2, TSSK2, DGCR14 | 4.44 | Exon + ve, 5 > ASD > 1, Normals < 2, Sanger – ve | 258 |
| 22 | 17274339 | 20141979 | 2867640 | gain | 1490 | CLTCL1, SLC25A1, GSC2 | 4.44 | Exon + ve, 5 > ASD > 1, Normals < 2, Sanger – ve | 258 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 22 | 17274339 | 20111070 | 2867640 | gain | 1490 | CLTCL1 | 4.44 | Exon + ve, 5 > ASD > 1, Normals < 2, Sanger – ve | 258 |
| 22 | 17274339 | 20141979 | 2867640 | gain | 1490 | HIRA, CLDN5, C22orf39, MRPL40, LOC150185, CDC45, UFD1L | 4.44 | Exon + ve, 5 > ASD > 1, Normals < 2, Sanger – ve | 258 |
| 22 | 17274339 | 20141979 | 2867640 | gain | 1490 | SEPT5, GP1BB, SEPT5-GP1BB | 4.44 | Exon + ve, 5 > ASD > 1, Normals < 2, Sanger – ve | 258 |
| 22 | 17274339 | 20141979 | 2867640 | gain | 1490 | GP1BB, SEPT5-GP1BB | 7.42 | Exon + ve, ASD > 4, Normals < 2, no Sanger filter applied | 258 |
| 22 | 17274339 | 20141979 | 2867640 | gain | 1490 | TBX1 | 5.92 | Exon + ve, 5 > ASD > 1, Normals < 2, Sanger – ve | 258 |
| 22 | 17274339 | 20141979 | 2867640 | gain | 1490 | TBX1 | 4.44 | Exon + ve, 5 > ASD > 1, Normals < 2, Sanger – ve | 258 |
| 22 | 17274339 | 20141979 | 2867640 | gain | 1490 | GNB1L, TBX1 | 4.44 | Exon + ve, 5 > ASD > 1, Normals < 2, Sanger – ve | 258 |
| 22 | 17274339 | 20141979 | 2867640 | gain | 1490 | ARVCF, MIR185, C22orf29, COMT, GNB1L, TXNRD2, C22orf25 | 4.44 | Exon + ve, 5 > ASD > 1, Normals < 2, Sanger – ve | 258 |
| 22 | 17274339 | 20141979 | 2867640 | gain | 1490 | DGCR8, ZDHHC8, MIR3618, TRMT2A, MIR1306, RANBP1, C22orf25 | 4.44 | Exon + ve, 5 > ASD > 1, Normals < 2, Sanger – ve | 258 |
| 22 | 17274339 | 20111979 | 2867640 | gain | 1490 | ZDHHC8 | 7.42 | Intron + ve, ASD > 4, Normals < 2, no Sanger Filter applied | 258 |
| 22 | 17274339 | 20141979 | 2867640 | gain | 1490 | ZDHHC8 | 11.92 | Exon + ve, ASD > 4, Normals < 2, no Sanger filter applied | 258 |
| 22 | 17274339 | 20141979 | 2867640 | gain | 1490 | ZDHHC8 | 17.98 | Exon + ve, ASD > 4, Normals < 2, no Sanger filter applied | 258 |
| 22 | 17274339 | 20141979 | 2867640 | gain | 1490 | ZDHHC8 | 5.92 | Exon + ve, 5 > ASD > 1, Normals < 2, Sanger – ve | 258 |
| 22 | 17274339 | 20141979 | 2867640 | gain | 1490 | SERPIND1, PI4KA | 4.44 | Exon + ve, 5 > ASD > 1, Normals < 2, Sanger – ve | 258 |
| 22 | 17274339 | 20141979 | 2867640 | gain | 1490 | CRKL, SNAP29, PI4KA | 4.44 | Exon + ve, 5 > ASD > 1, Normals < 2, Sanger – ve | 258 |
| 22 | 17274339 | 20141979 | 2867640 | gain | 1490 | CRKL | 8.91 | Intron + ve, ASD > 4, Normals < 2, no Sanger filter applied | 258 |
| 22 | 17274339 | 20141979 | 2867640 | gain | 1490 | CRKL | 5.92 | Exon + ve, 5 > ASD > 1, Normals < 2, Sanger – ve | 258 |
| 22 | 17431181 | 17433410 | 2229 | loss | 1598 | DGCR2 | 8.91 | Exon + ve, ASD > 4, Normals < 2, no Sanger filter applied | 500 |
| 22 | 17431181 | 17433410 | 2229 | loss | 1623 | DGCR2 | 8.91 | Exon + ve, ASD > 4, Normals < 2, no Sanger filter applied | 500 |
| 22 | 17431181 | 17433410 | 2229 | loss | 1641 | DGCR2 | 8.91 | Exon + ve, ASD > 4, Normals < 2, no Sanger lifter applied | 500 |
| 22 | 18092255 | 18093176 | 921 | gain | 1780 | GP1BB, SEPT5-GP1BB | 7.42 | Exon + ve, ASD > 4, Normals < 2, no Sanger filter applied | 619 |
| 22 | 18092255 | 18095689 | 3434 | loss | 2005 | GP1BB, SEPT5-GP1BB | 7.42 | Exon + ve, ASD > 4, Normals < 2, no Sanger filter applied | 620 |
| 22 | 18123761 | 18127933 | 4172 | loss | 2005 | TBX1 | 5.92 | Exon + ve, 5 > ASD > 1, Normals < 2, Sanger – ve | 660 |
| 22 | 18131561 | 19794060 | 1662499 | gain | 1844 | TBX1 | 4.44 | Exon + ve, 5 > ASD > 1, Normals < 2, Sanger – ve | 261 |
| 22 | 18131561 | 19794060 | 1662499 | gain | 1844 | GNB1L, TBX1 | 4.44 | Exon + ve, 5 > ASD > 1, Normals < 2, Sanger – ve | 261 |
| 22 | 18131561 | 19794060 | 1662499 | gain | 1844 | ARVCF, MIR185, C22orf29, COMT, GNB1L, TXNRD2, C22orf25 | 4.44 | Exon + ve, 5 > ASD > 1, Normals < 2, Sanger – ve | 261 |
| 22 | 18131561 | 19794060 | 1662499 | gain | 1844 | DGCR8, ZDHHC8, MIR3618, TRMT2A, MIR1306, RANBP1, C22orf25 | 4.44 | Exon + ve, 5 > ASD > 1, Normals < 2, Sanger – ve | 261 |
| 22 | 18131561 | 19794060 | 1662499 | gain | 1844 | ZDHHC8 | 7.42 | Intron + ve, ASD > 4, Normals < 2, no Sanger filter applied | 261 |
| 22 | 18131561 | 19794060 | 1662499 | gain | 1844 | ZDHHC8 | 11.92 | Exon + ve, ASD > 4, Normals < 2, no Sanger filter applied | 261 |
| 22 | 18131561 | 19794060 | 1662499 | gain | 1844 | ZDHHC8 | 17.98 | Exon + ve, ASD > 4, Normals < 2, no Sanger filter applied | 261 |
| 22 | 18131561 | 19794060 | 1662499 | gain | 1844 | ZDHHC8 | 5.92 | Exon + ve, 5 > ASD > 1, Normals < 2, Sanger – ve | 261 |
| 22 | 18131561 | 19794060 | 1662499 | gain | 1844 | SERPIND1, PI4KA | 4.44 | Exon + ve, 5 > ASD > 1, Normals < 2, Sanger – ve | 261 |
| 22 | 18131561 | 19794060 | 1662499 | gain | 1844 | CRKL, SNAP29, PI4KA | 4.44 | Exon + ve, 5 > ASD > 1, Normals < 2, Sanger – ve | 261 |
| 22 | 18131561 | 19794060 | 1662499 | gain | 1844 | CRKL | 8.91 | Intron + ve, ASD > 4, Normals < 2, no Sanger filter applied | 261 |
| 22 | 18131561 | 19794060 | 1662499 | gain | 1844 | CRKL | 5.92 | Exon + ve, 5 > ASD > 1, Normals < 2, Sanger – ve | 261 |
| 22 | 18504519 | 18513615 | 9096 | loss | 1963 | ZDHHC8 | 7.42 | Intron + ve, ASD > 4, Normals < 2, no Sanger filter applied | 262 |
| 22 | 18504519 | 18513615 | 9096 | loss | 1968 | ZDHHC8 | 7.42 | Intron + ve, ASD > 4, Normals < 2, no Sanger filter applied | 262 |
| 22 | 18504519 | 18513615 | 9096 | loss | 1963 | ZDHHC8 | 11.92 | Exon + ve, ASD > 4, Normals < 2, no Sanger filter applied | 262 |
| 22 | 18504519 | 18513615 | 9096 | loss | 1968 | ZDHHC8 | 11.92 | Exon + ve, ASD > 4, Normals < 2, no Sanger filter applied | 262 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 22 | 18804519 | 18813615 | 9096 | loss | 1963 | ZDHHC8 | 17.98 | Exon + ve, ASD > 4, Normals < 2, no Sanger filter applied | 262 |
| 22 | 18804519 | 18813615 | 9096 | loss | 1968 | ZDHHC8 | 17.98 | Exon + ve, ASD > 4, Normals < 2, no Sanger filter applied | 262 |
| 22 | 18805513 | 18813615 | 8102 | loss | 1557 | ZDHHC8 | 11.92 | Exon + ve, ASD > 4, Normals < 2, no Sanger filter applied | 259 |
| 22 | 18805513 | 18819020 | 13507 | loss | 1991 | ZDHHC8 | 11.92 | Exon + ve, ASD > 4, Normals < 2, no Sanger filter applied | 263 |
| 22 | 18805513 | 18813615 | 8102 | loss | 1993 | ZDHHC8 | 11.92 | Exon + ve, ASD > 4, Normals < 2, no Sanger filter applied | 259 |
| 22 | 18805513 | 18813615 | 8102 | loss | 1557 | ZDHHC8 | 17.98 | Exon + ve, ASD > 4, Normals < 2, no Sanger filter applied | 259 |
| 22 | 18805513 | 18819020 | 13507 | loss | 1991 | ZDHHC8 | 17.98 | Exon + ve, ASD > 4, Normals < 2, no Sanger filter applied | 263 |
| 22 | 18805513 | 18813615 | 8102 | loss | 1993 | ZDHHC8 | 17.98 | Exon + ve, ASD > 4, Normals < 2, no Sanger filter applied | 259 |
| 22 | 18805513 | 18819020 | 13507 | loss | 1991 | ZDHHC8 | 5.92 | Exon + ve, 5 > ASD > 1, Normals < 2, Sanger – ve | 263 |
| 22 | 18807465 | 18813615 | 6150 | loss | 1314 | ZDHHC8 | 17.98 | Exon + ve, ASD > 4, Normals < 2, no Sanger filter applied | 257 |
| 22 | 18807465 | 18813615 | 6150 | loss | 1833 | ZDHHC8 | 17.98 | Exon + ve, ASD > 4, Normals < 2, no Sanger filter applied | 257 |
| 22 | 18807465 | 18813615 | 6150 | loss | 1859 | ZDHHC8 | 17.98 | Exon + ve, ASD > 4, Normals < 2, no Sanger filter applied | 257 |
| 22 | 18807465 | 18813615 | 6150 | loss | 2043 | ZDHHC8 | 17.98 | Exon + ve, ASD > 4, Normals < 2, no Sanger filter applied | 257 |
| 22 | 19607268 | 19620943 | 13675 | gain | 1242 | CRKL | 8.91 | Intron + ve, ASD > 4, Normals < 2, no Sanger filter applied | 502 |
| 22 | 19607268 | 19620943 | 13675 | gain | 1242 | CRKL | 5.92 | Exon + ve, 5 > ASD > 1, Normals < 2, Sanger – ve | 502 |
| 22 | 19615302 | 19616903 | 1601 | loss | 1633 | CRKL | 8.91 | Intron + ve, ASD > 4, Normals < 2, no Sanger filter applied | 503 |
| 22 | 19615302 | 19616903 | 1601 | gain | 1717 | CRKL | 8.91 | Intron + ve, ASD > 4, Normals < 2, no Sanger filter applied | 503 |
| 22 | 22603439 | 22735036 | 131597 | loss | 1618 | DDTL, DDT | 8.2 | Genic (distinct CNV-subregions); OR > 6 | 433 |
| 22 | 22603439 | 22735036 | 131597 | loss | 1618 | DDTL, GSTT2, DDT | 8.2 | Genic (distinct CNV-subregions); OR > 6 | 433 |
| 22 | 22603439 | 22735036 | 131597 | loss | 1618 | DDTL, GSTT2B, GSTT2, DDT | 8.2 | Genic (distinct CNV-subregions); OR > 6 | 433 |
| 22 | 22603439 | 22735036 | 131597 | loss | 1618 | GSTTP2 | 10.41 | Exon ve, ASD 4, Normals < 2, no Sanger filter applied | 430 |
| 22 | 22618049 | 22725305 | 107256 | loss | 1263 | DDTL, DDT | 8.2 | Genic (distinct CNV-subregions); OR > 6 | 511 |
| 22 | 22618049 | 22725305 | 107256 | loss | 1278 | DDTL, DDT | 8.2 | Genic (distinct CNV-subregions); OR > 6 | 511 |
| 22 | 22618049 | 22736990 | 118941 | loss | 1282 | DDTL, DDT | 8.2 | Genic (distinct CNV-subregions); OR > 6 | 430 |
| 22 | 22618049 | 22725305 | 107256 | loss | 1468 | DDTL, DDT | 8.2 | Genic (distinct CNV-subregions); OR > 6 | 511 |
| 22 | 22618049 | 22720195 | 102146 | loss | 1489 | DDTL, DDT | 8.2 | Genic (distinct CNV-subregions); OR > 6 | 512 |
| 22 | 22618049 | 22725305 | 107256 | loss | 1564 | DDTL, DDT | 8.2 | Genic (distinct CNV-subregions); OR > 6 | 511 |
| 22 | 22618049 | 22721042 | 102993 | loss | 1568 | DDTL, DDT | 8.2 | Genic (distinct CNV-subregions); OR > 6 | 513 |
| 22 | 22618049 | 22725305 | 107256 | loss | 1573 | DDTL, DDT | 8.2 | Genic (distinct CNV-subregions); OR > 6 | 511 |
| 22 | 22618049 | 22667608 | 49559 | loss | 1602 | DDTL, DDT | 8.2 | Genic (distinct CNV-subregions); OR > 6 | 514 |
| 22 | 22618049 | 22725305 | 107256 | loss | 1671 | DDTL, DDT | 8.2 | Genic (distinct CNV-subregions); OR > 6 | 511 |
| 22 | 22618049 | 22725305 | 107256 | loss | 1716 | DDTL, DDT | 8.2 | Genic (distinct CNV-subregions); OR > 6 | 511 |
| 22 | 22618049 | 22721042 | 102993 | loss | 1742 | DDTL, DDT | 8.2 | Genic (distinct CNV-subregions); OR > 6 | 513 |
| 22 | 22618049 | 22725305 | 107256 | loss | 1819 | DDTL, DDT | 8.2 | Genic (distinct CNV-subregions); OR > 6 | 511 |
| 22 | 22618049 | 22725305 | 107256 | loss | 1833 | DDTL, DDT | 8.2 | Genic (distinct CNV-subregions); OR > 6 | 511 |
| 22 | 22618049 | 22725305 | 107256 | loss | 1851 | DDTL, DDT | 8.2 | Genic (distinct CNV-subregions); OR > 6 | 511 |
| 22 | 22618049 | 22725305 | 107256 | loss | 1263 | DDTL, GSTT2, DDT | 8.2 | Genic (distinct CNV-subregions); OR > 6 | 511 |
| 22 | 22618049 | 22725305 | 107256 | loss | 1278 | DDTL, GSTT2, DDT | 8.2 | Genic (distinct CNV-subregions); OR > 6 | 511 |
| 22 | 22618049 | 22736990 | 118941 | loss | 1282 | DDTL, GSTT2, DDT | 8.2 | Genic (distinct CNV-subregions); OR > 6 | 430 |
| 22 | 22618049 | 22725305 | 107256 | loss | 1468 | DDTL, GSTT2, DDT | 8.2 | Genic (distinct CNV-subregions); OR > 6 | 511 |
| 22 | 22618049 | 22720195 | 102146 | loss | 1489 | DDTL, GSTT2, DDT | 8.2 | Genic (distinct CNV-subregions); OR > 6 | 512 |
| 22 | 22618049 | 22725305 | 107256 | loss | 1564 | DDTL, GSTT2, DDT | 8.2 | Genic (distinct CNV-subregions); OR > 6 | 511 |
| 22 | 22618049 | 22721042 | 102993 | loss | 1568 | DDTL, GSTT2, DDT | 8.2 | Genic (distinct CNV-subreaions); OR > 6 | 513 |
| 22 | 22618049 | 22725305 | 107256 | loss | 1573 | DDTL, GSTT2, DDT | 8.2 | Genic (distinct CNV-subregions); OR > 6 | 511 |
| 22 | 22618049 | 22667608 | 49559 | loss | 1602 | DDTL, GSTT2, DDT | 8.2 | Genic (distinct CNV-subregions); OR > 6 | 514 |
| 22 | 22618049 | 22725305 | 107256 | loss | 1671 | DDTL, GSTT2, DDT | 8.2 | Genic (distinct CNV-subregions); OR > 6 | 511 |
| 22 | 22618019 | 22721042 | 102993 | loss | 1716 | DDTL, GSTT2, DDT | 8.2 | Genic (distinct CNV-subregions); OR > 6 | 513 |
| 22 | 22618049 | 22725305 | 107256 | loss | 1742 | DDTL, GSTT2, DDT | 8.2 | Genic (distinct CNV-subregions); OR > 6 | 511 |
| 22 | 22618049 | 22725305 | 107256 | loss | 1819 | DDTL, GSTT2, DDT | 8.2 | Genic (distinct CNV-subregions); OR > 6 | 511 |
| 22 | 22618049 | 22725305 | 107256 | loss | 1833 | DDTL, GSTT2, DDT | 8.2 | Genic (distinct CNV-subregions); OR > 6 | 511 |
| 22 | 22618049 | 22725305 | 107256 | loss | 1851 | DDTL, GSTT2, DDT | 8.2 | Genic (distinct CNV-subregions); OR > 6 | 511 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 22 | 22618049 | 22725305 | 107256 | loss | 1263 | DDTL, GSTT2B, GSTT2, DDT | 8.2 | Genic (distinct CNV-subregions); OR > 6 | 511 |
| 22 | 22618049 | 22725305 | 107256 | loss | 1278 | DDTL, GSTT2B, GSTT2, DDT | 8.2 | Genic (distinct CNV-subregions); OR > 6 | 511 |
| 22 | 22618049 | 22736990 | 118941 | loss | 1282 | DDTL, GSTT2B, GSTT2, DDT | 8.2 | Genic (distinct CNV-subregions); OR > 6 | 430 |
| 22 | 22618049 | 22725305 | 107256 | loss | 1468 | DDTL, GSTT2B, GSTT2, DDT | 8.2 | Genic (distinct CNV-subregions); OR > 6 | 511 |
| 22 | 22618049 | 22720195 | 102146 | loss | 1489 | DDTL, GSTT2B, GSTT2, DDT | 8.2 | Genic (distinct CNV-subregions); OR > 6 | 512 |
| 22 | 22618049 | 22725305 | 107256 | loss | 1564 | DDTL, GSTT2B, GSTT2, DDT | 8.2 | Genic (distinct CNV-subregions); OR > 6 | 511 |
| 22 | 22618049 | 22721042 | 102993 | loss | 1568 | DDTL, GSTT2B, GSTT2, DDT | 8.2 | Genic (distinct CNV-subregions); OR > 6 | 513 |
| 22 | 22618049 | 22667608 | 49559 | loss | 1573 | DDTL, GSTT2B, GSTT2, DDT | 8.2 | Genic (distinct CNV-subregions); OR > 6 | 514 |
| 22 | 22618049 | 22725305 | 107256 | loss | 1602 | DDTL, GSTT2B, GSTT2, DDT | 8.2 | Genic (distinct CNV-subregions); OR > 6 | 511 |
| 22 | 22618049 | 22725305 | 107256 | loss | 1671 | DDTL, GSTT2B, GSTT2, DDT | 8.2 | Genic (distinct CNV-subregions); OR > 6 | 511 |
| 22 | 22618049 | 22721042 | 102993 | loss | 1716 | DDTL, GSTT2B, GSTT2, DDT | 8.2 | Genic (distinct CNV-subregions); OR > 6 | 513 |
| 22 | 22618049 | 22725305 | 107256 | loss | 1742 | DDTL, GSTT2B, GSTT2, DDT | 8.2 | Genic (distinct CNV-subregions); OR > 6 | 511 |
| 22 | 22618049 | 22725305 | 107256 | loss | 1819 | DDTL, GSTT2B, GSTT2, DDT | 8.2 | Genic (distinct CNV-subregions); OR > 6 | 511 |
| 22 | 22618049 | 22725305 | 107256 | loss | 1833 | DDTL, GSTT2B, GSTT2, DDT | 8.2 | Genic (distinct CNV-subregions); OR > 6 | 511 |
| 22 | 22618049 | 22725305 | 107256 | loss | 1851 | DDTL, GSTT2B, GSTT2, DDT | 8.2 | Genic (distinct CNV-subregions); OR > 6 | 511 |
| 22 | 22618049 | 22736990 | 118941 | loss | 1282 | GSTTP2 | 10.41 | Exon + ve, ASD > 4, Normals < 2, no Sanger filter applied | 430 |
| 22 | 22643742 | 22721042 | 77300 | loss | 1606 | DDTL, DDT | 8.2 | Genic (distinct CNV-subregions); OR > 6 | 515 |
| 22 | 22643742 | 22725305 | 81563 | loss | 1741 | DDTL, DDL | 8.2 | Genic (distinct CNV-subregions); OR > 6 | 516 |
| 22 | 22643712 | 22721042 | 77300 | loss | 1606 | DDTL, GSTT2, DDT | 8.2 | Genic (distinct CNV-subregions); OR > 6 | 515 |
| 22 | 22643742 | 22725305 | 81563 | loss | 1741 | DDTL, GSTT2, DDT | 8.2 | Genic (distinct CNV-subregions); OR > 6 | 516 |
| 22 | 22644243 | 22721042 | 76799 | loss | 1232 | DDTL, GSTT2, DDT | 8.2 | Genic (distinct CNV-subregions); OR > 6 | 517 |
| 22 | 22644243 | 22725305 | 81062 | loss | 1268 | DDTL, GSTT2, DDT | 8.2 | Genic (distinct CNV-subregions); OR > 6 | 518 |
| 22 | 22644243 | 22720195 | 75952 | loss | 1496 | DDTL, GSTT2, DDT | 8.2 | Genic (distinct CNV-subregions); OR > 6 | 519 |
| 22 | 22644243 | 22725305 | 81062 | loss | 1533 | DDTL, GSTT2, DDT | 8.2 | Genic (distinct CNV-subregions); OR > 6 | 518 |
| 22 | 22644243 | 22677959 | 33716 | loss | 1534 | DDTL, GSTT2, DDT | 8.2 | Genic (distinct CNV-subregions); OR > 6 | 520 |
| 22 | 22644243 | 22725305 | 81062 | loss | 1656 | DDTL, GSTT2, DDT | 8.2 | Genic (distinct CNV-subregions); OR > 6 | 518 |
| 22 | 22644243 | 22720195 | 75952 | loss | 1667 | DDTL, GSTT2, DDT | 8.2 | Genic (distinct CNV-subregions); OR > 6 | 519 |
| 22 | 22644243 | 22720195 | 75952 | loss | 1669 | DDTL, GSTT2, DDT | 8.2 | Genic (distinct CNV-subregions); OR > 6 | 519 |
| 22 | 22644243 | 22725305 | 81062 | loss | 1720 | DDTL, GSTT2, DDT | 8.2 | Genic (distinct CNV-subregions); OR > 6 | 518 |
| 22 | 22644243 | 22725305 | 81062 | loss | 1729 | DDTL, GSTT2, DDT | 8.2 | Genic (distinct CNV-subregions); OR > 6 | 518 |
| 22 | 22644243 | 22720195 | 75952 | loss | 1809 | DDTL, GSTT2, DDT | 8.2 | Genic (distinct CNV-subregions); OR > 6 | 519 |
| 22 | 22644243 | 22725305 | 81062 | loss | 1868 | DDTL, GSTT2, DDT | 8.2 | Genic (distinct CNV-subregions); OR > 6 | 518 |
| 22 | 22644243 | 22720195 | 75952 | loss | 2037 | DDTL, GSTT2, DDT | 8.2 | Genic (distinct CNV-subregions); OR > 6 | 519 |
| 22 | 22644243 | 22725305 | 81062 | loss | 2040 | DDTL, GSTT2, DDT | 8.2 | Genic (distinct CNV-subregions); OR > 6 | 518 |
| 22 | 22667608 | 22739574 | 71966 | loss | 1345 | GSTTP2 | 10.41 | Exon + ve, ASD > 4, Normals < 2, no Sanger filter applied | 431 |
| 22 | 22667608 | 22736990 | 69382 | loss | 1792 | GSTTP2 | 10.41 | Exon + ve, ASD > 4, Normals < 2, no Sanger filter applied | 434 |
| 22 | 22677959 | 22735036 | 57077 | gain | 1412 | GSTTP2 | 10.41 | Exon + ve, ASD > 4, Normals < 2, no Sanger filter applied | 432 |
| 22 | 22677959 | 22735036 | 57077 | gain | 1449 | GSTTP2 | 10.41 | Exon + ve, ASD > 4, Normals < 2, no Sanger filter applied | 432 |
| 22 | 22677959 | 22735036 | 57077 | gain | 1639 | GSTTP2 | 10.41 | Exon + ve, ASD > 4, Normals < 2, no Sanger filter applied | 432 |
| 22 | 27921706 | 28639409 | 717703 | loss | 1581 | ZMAT5 | 2.95 | Exon + ve, 5 > ASD > 1, Normals < 2, Sanger − ve | 821 |
| 22 | 28479825 | 28481680 | 1855 | gain | 1468 | ZMAT5 | 2.95 | Exon + ve, 5 > ASD > 1, Normals < 2, Sanger − ve | 820 |
| 22 | 34122937 | 34133937 | 11000 | loss | 1432 | MCM5 | 7.42 | Exon + ve, ASD > 4, Normals < 2, no Sanger filter applied | 504 |
| 22 | 34122937 | 34133937 | 11000 | loss | 1438 | MCM5 | 7.42 | Exon + ve, ASD > 4, Normals < 2, no Sanger filter applied | 504 |
| 22 | 34122937 | 34133937 | 11000 | loss | 1823 | MCM5 | 7.42 | Exon + ve, ASD > 4, Normals < 2, no Sanger filter applied | 504 |
| 22 | 34122937 | 34133937 | 11000 | loss | 1875 | MCM5 | 7.42 | Exon + ve, ASD > 4, Normals < 2, no Sanger filter applied | 504 |
| 22 | 34132976 | 34133937 | 10039 | loss | 1908 | MCM5 | 7.42 | Exon + ve, ASD > 4, Normals < 2, no Sanger filter applied | 505 |
| 22 | 34122937 | 34133937 | 11000 | loss | 1432 | MCM5 | 8.91 | Exon + ve, ASD > 4, Normals < 2, no Sanger filter applied | 504 |
| 22 | 34122937 | 34133937 | 11000 | loss | 1438 | MCM5 | 8.91 | Exon + ve, ASD > 4, Normals < 2, no Sanger filter applied | 504 |
| 22 | 34122937 | 34133937 | 11000 | loss | 1823 | MCM5 | 8.91 | Exon + ve, ASD > 4, Normals < 2, no Sanger filter applied | 504 |
| 22 | 34122937 | 34133937 | 11000 | loss | 1875 | MCM5 | 8.91 | Exon + ve, ASD > 4, Normals < 2, no Sanger filter applied | 504 |
| 22 | 34132976 | 34133937 | 10039 | loss | 1908 | MCM5 | 8.91 | Exon + ve, ASD > 4, Normals < 2, no Sanger filter applied | 505 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 22 | 34122937 | 34133937 | 11000 | loss | 1432 | MCM5 | 7.42 | Exon + ve, ASD > 4, Normals < 2, no Sanger filter applied | 504 |
| 22 | 34122937 | 34133937 | 11000 | loss | 1438 | MCM5 | 7.42 | Exon + ve, ASD > 4, Normals < 2, no Sanger filter applied | 504 |
| 22 | 34122937 | 34133937 | 11000 | loss | 1823 | MCM5 | 7.42 | Exon + ve, ASD > 4, Normals < 2, no Sanger filter applied | 504 |
| 22 | 34122937 | 34133937 | 11000 | loss | 1875 | MCM5 | 7.42 | Exon + ve, ASD > 4, Normals < 2, no Sanger filter applied | 504 |
| 22 | 34122937 | 34132976 | 10039 | loss | 1908 | MCM5 | 7.42 | Exon + ve, ASD > 4, Normals < 2, no Sanger filter applied | 505 |
| 22 | 34129033 | 34130625 | 1592 | loss | 2031 | MCM5 | 8.91 | Exon + ve, ASD > 4, Normals < 2, no Sanger filter applied | 506 |
| 22 | 37685496 | 37715385 | 29889 | loss | 1252 | APOBEC3A | 49.43 | Exon + ve, ASD > 4, Normals < 2, no Sanger filter applied | 88 |
| 22 | 37685496 | 37715385 | 29889 | loss | 1277 | APOBEC3A | 49.43 | Exon + ve, ASD > 4, Normals < 2, no Sanger filter applied | 88 |
| 22 | 37685496 | 37715385 | 29889 | loss | 1300 | APOBEC3A | 49.43 | Exon + ve, ASD > 4, Normals < 2, no Sanger filter applied | 88 |
| 22 | 37685496 | 37715385 | 29889 | loss | 1311 | APOBEC3A | 49.43 | Exon + ve, ASD > 4, Normals < 2, no Sanger filter applied | 88 |
| 22 | 37685496 | 37715385 | 29889 | loss | 1333 | APOBEC3A | 49.43 | Exon + ve, ASD > 4, Normals < 2, no Sanger filter applied | 88 |
| 22 | 37685496 | 37715385 | 29889 | loss | 1389 | APOBEC3A | 49.43 | Exon + ve, ASD > 4, Normals < 2, no Sanger filter applied | 88 |
| 22 | 37685496 | 37715385 | 29889 | loss | 1391 | APOBEC3A | 49.43 | Exon + ve, ASD > 4, Normals < 2, no Sanger filter applied | 88 |
| 22 | 37685496 | 37715385 | 29889 | loss | 1395 | APOBEC3A | 49.43 | Exon + ve, ASD > 4, Normals < 2, no Sanger filter applied | 88 |
| 22 | 37685496 | 37715385 | 29889 | loss | 1396 | APOBEC3A | 49.43 | Exon + ve, ASD > 4, Normals < 2, no Sanger filter applied | 88 |
| 22 | 37685496 | 37715385 | 29889 | loss | 1463 | APOBEC3A | 49.43 | Exon + ve, ASD > 4, Normals < 2, no Sanger filter applied | 88 |
| 22 | 37685496 | 37715385 | 29889 | loss | 1465 | APOBEC3A | 49.43 | Exon + ve, ASD > 4, Normals < 2, no Sanger filter applied | 88 |
| 22 | 37685496 | 37715385 | 29889 | loss | 1614 | APOBEC3A | 49.43 | Exon + ve, ASD > 4, Normals < 2, no Sanger filter applied | 88 |
| 22 | 37685496 | 37715385 | 29889 | loss | 1617 | APOBEC3A | 49.43 | Exon + ve, ASD > 4, Normals < 2, no Sanger filter applied | 88 |
| 22 | 37685496 | 37715385 | 29889 | loss | 1618 | APOBEC3A | 49.43 | Exon + ve, ASD > 4, Normals < 2, no Sanger filter applied | 88 |
| 22 | 37685496 | 37715385 | 29889 | loss | 1635 | APOBEC3A | 49.43 | Exon + ve, ASD > 4, Normals < 2, no Sanger filter applied | 88 |
| 22 | 37685496 | 37715385 | 29889 | loss | 1660 | APOBEC3A | 49.43 | Exon + ve, ASD > 4, Normals < 2, no Sanger filter applied | 88 |
| 22 | 37685496 | 37715385 | 29889 | loss | 1664 | APOBEC3A | 49.43 | Exon + ve, ASD > 4, Normals < 2, no Sanger filter applied | 88 |
| 22 | 37685496 | 37715385 | 29889 | loss | 1683 | APOBEC3A | 49.43 | Exon + ve, ASD > 4, Normals < 2, no Sanger filter applied | 88 |
| 22 | 37685496 | 37715385 | 29889 | loss | 1697 | APOBEC3A | 49.43 | Exon + ve, ASD > 4, Normals < 2, no Sanger filter applied | 88 |
| 22 | 37685496 | 37715385 | 29889 | loss | 1740 | APOBEC3A | 49.43 | Exon + ve, ASD > 4, Normals < 2, no Sanger filter applied | 88 |
| 22 | 37685496 | 37715385 | 29889 | loss | 1743 | APOBEC3A | 49.43 | Exon + ve, ASD > 4, Normals < 2, no Sanger filter applied | 88 |
| 22 | 37685496 | 37715385 | 29889 | loss | 1765 | APOBEC3A | 49.43 | Exon + ve, ASD > 4, Normals < 2, no Sanger filter applied | 88 |
| 22 | 37685496 | 37715385 | 29889 | loss | 1767 | APOBEC3A | 49.43 | Exon + ve, ASD > 4, Normals < 2, no Sanger filter applied | 88 |
| 22 | 37685496 | 37715385 | 29889 | loss | 1769 | APOBEC3A | 49.43 | Exon + ve, ASD > 4, Normals < 2, no Sanger filter applied | 88 |
| 22 | 37685496 | 37715385 | 29889 | loss | 1774 | APOBEC3A | 49.43 | Exon + ve, ASD > 4, Normals < 2, no Sanger filter applied | 88 |
| 22 | 37685496 | 37715385 | 29889 | loss | 1778 | APOBEC3A | 49.43 | Exon + ve, ASD > 4, Normals < 2, no Sanger filter applied | 88 |
| 22 | 37685496 | 37715385 | 29889 | loss | 1783 | APOBEC3A | 49.43 | Exon + ve, ASD > 4, Normals < 2, no Sanger filter applied | 88 |
| 22 | 37685496 | 37718669 | 33173 | loss | 1830 | APOBEC3A | 49.43 | Exon + ve, ASD > 4, Normals < 2, no Sanger filter applied | 89 |
| 22 | 37685496 | 37715385 | 29889 | loss | 1842 | APOBEC3A | 49.43 | Exon + ve, ASD > 4, Normals < 2, no Sanger filter applied | 88 |
| 22 | 37685496 | 37715385 | 29889 | loss | 1867 | APOBEC3A | 49.43 | Exon + ve, ASD > 4, Normals < 2, no Sanger filter applied | 88 |
| 22 | 37685496 | 37715385 | 29889 | loss | 1920 | APOBEC3A | 49.43 | Exon + ve, ASD > 4, Normals < 2, no Sanger filter applied | 88 |
| 22 | 37685496 | 37715385 | 29889 | loss | 2020 | APOBEC3A | 49.43 | Exon + ve, ASD > 4, Normals < 2, no Sanger filter applied | 88 |
| 23 | 2554044 | 2747802 | 193758 | gain | 1917 | XG | 8.91 | Exon + ve, ASD > 4, Normals < 2, no Sanger filter applied | 510 |
| 23 | 2554044 | 2747802 | 193758 | gain | 1917 | XG | 8.91 | Exon + ve, ASD > 4, Normals < 2, no Sanger filter applied | 510 |
| 23 | 2705374 | 2814330 | 108956 | gain | 1434 | XG | 8.91 | Exon + ve, ASD > 4, Normals < 2, no Sanger filter applied | 508 |
| 23 | 2705374 | 2814330 | 108956 | gain | 1434 | XG | 8.91 | Exon + ve, ASD > 4, Normals < 2, no Sanger filter applied | 508 |
| 23 | 2705378 | 2814330 | 108952 | gain | 1509 | XG | 8.91 | Exon + ve, ASD > 4, Normals < 2, no Sanger filter applied | 509 |
| 23 | 2705378 | 2814330 | 108952 | gain | 1732 | XG | 8.91 | Exon + ve, ASD > 4, Normals < 2, no Sanger filter applied | 509 |
| 23 | 2705378 | 2814330 | 108952 | gain | 1825 | XG | 8.91 | Exon + ve, ASD > 4, Normals < 2, no Sanger filter applied | 509 |
| 23 | 2705378 | 2814330 | 108952 | gain | 1509 | XG | 8.91 | Exon + ve, ASD > 4, Normals < 2, no Sanger filter applied | 509 |
| 23 | 2705378 | 2814330 | 108952 | gain | 1732 | XG | 8.91 | Exon + ve, ASD > 4, Normals < 2, no Sanger filter applied | 509 |
| 23 | 2705378 | 2814330 | 108952 | gain | 1825 | XG | 8.91 | Exon + ve, ASD > 4, Normals < 2, no Sanger filter applied | 509 |
| 23 | 2711273 | 36573368 | 33862095 | gain | 1337 | ARSF | 8.91 | Exon + ve, ASD > 4, Normals < 2, no Sanger filter applied | 507 |
| 23 | 2711273 | 36573368 | 33862095 | gain | 1337 | ARSF | 8.91 | Exon + ve, ASD > 4, Normals < 2, no Sanger filter applied | 507 |
| 23 | 2711273 | 36573368 | 33862095 | gain | 1337 | ARSF | 2.95 | Exon + ve, 5 > ASD > 1, Normals < 2, Sanger − ve | 507 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 23 | 2711273 | 36573368 | 33862095 | gain | 1337 | NLGN4X | 2.95 | Exon + ve, 5 > ASD > 1, Normals < 2, Sanger – ve | 507 |
| 23 | 2711273 | 36573368 | 33862095 | gain | 1337 | CA5BP1,TMEM27 | 2.95 | Exon + ve, 5 > ASD > 1, Normals < 2, Sanger – ve | 507 |
| 23 | 2711273 | 36573368 | 33862095 | gain | 1337 | DDX53 | 2.95 | Exon + ve, 5 > ASD > 1, Normals < 2, Sanger – ve | 507 |
| 23 | 2711273 | 36573368 | 33862095 | gain | 1337 | APOO | 4.44 | Exon + ve, 5 > ASD > 1, Normals < 2, Sanger – ve | 507 |
| 23 | 2711273 | 36573368 | 33862095 | gain | 1337 | DMD | 4.44 | Exon + ve, 5 > ASD > 1, Normals < 2, Sanger – ve | 507 |
| 23 | 2749116 | 3191663 | 442547 | gain | 1917 | ARSF | 2.95 | Exon + ve, 5 > ASD > 1, Normals < 2, Sanger – ve | 822 |
| 23 | 6156507 | 6107101 | 250894 | gain | 1570 | NLGN4X | 2.95 | Exon + ve, 5 > ASD > 1, Normals < 2, Sanger – ve | 823 |
| 23 | 15576976 | 15628244 | 51268 | loss | 1413 | CA5BP1, TMEM27 | 2.95 | Exon + ve, 5 > ASD > 1, Normals < 2, Sanger – ve | 824 |
| 23 | 22891406 | 23015097 | 123691 | loss | 1811 | DDX53 | 2.95 | Exon + ve, 5 > ASD > 1, Normals < 2, Sanger – ve | 825 |
| 23 | 23760270 | 23778330 | 18060 | gain | 1527 | APOO | 2.05 | Exon + ve, 5 > ASD > 1, Normals < 2, Sanger – ve | 731 |
| 23 | 23760270 | 23778330 | 18060 | gain | 1527 | APOO | 4.44 | Exon + ve, 5 > ASD > 1, Normals < 2, Sanger – ve | 731 |
| 23 | 23761633 | 23778330 | 16697 | gain | 1619 | APOO | 4.44 | Exon + ve, 5 > ASD > 1, Normals < 2, Sanger – ve | 732 |
| 23 | 31793198 | 31823142 | 29944 | loss | 1562 | DMD | 2.95 | Exon + ve, 5 > ASD > 1, Normals < 2, Sanger – ve | 826 |
| 23 | 36649382 | 154442377 | 117792995 | gain | 1337 | PRRG1 | 4.44 | Exon + ve, 5 > ASD > 1, Normals < 2, Sanger – ve | 621 |
| 23 | 36649382 | 154442377 | 117792995 | gain | 1337 | SYTL5, CXorf27 | 2.95 | Exon + ve, 5 > ASD > 1, Normals < 2, Sanger – ve | 621 |
| 23 | 36649382 | 154442377 | 117792995 | gain | 1337 | ZNF674, LOC401588 | 2.95 | Exon + ve, 5 > ASD > 1, Normals < 2, Sanger – ve | 621 |
| 23 | 36649382 | 154442377 | 117792995 | gain | 1337 | GLOD5 | 2.95 | Exon + ve, 5 > ASD > 1, Normals < 2, Sanger – ve | 621 |
| 23 | 36649382 | 154442377 | 117792995 | gain | 1337 | NUDT10, NUDT11 | 2.95 | Exon + ve, 5 > ASD > 1, Normals < 2, Sanger – ve | 621 |
| 23 | 36649382 | 154442377 | 117792995 | gain | 1337 | LOC441495,CENPVL1 | 2.95 | Exon + ve, 5 > ASD > 1, Normals < 2, Sanger – ve | 621 |
| 23 | 36649382 | 154442377 | 117792995 | gain | 1337 | SPIN4, LOC92249 | 2.95 | Exon + ve, 5 > ASD > 1, Normals < 2, Sanger – ve | 621 |
| 23 | 36649382 | 154442377 | 117792995 | gain | 1337 | EDA2R | 5.92 | Exon + ve, 5 > ASD > 1, Normals < 2, Sanger – ve | 621 |
| 23 | 36649382 | 154442377 | 117792995 | gain | 1337 | NCRNA00183 | 7.42 | Intron + ve, ASD > 4, Normals < 2, no Sanger filter applied | 621 |
| 23 | 36649382 | 154442377 | 117792995 | gain | 1337 | MAGT1 | 5.92 | Exon + ve, 5 > ASD > 1, Normals < 2, Sanger – ve | 621 |
| 23 | 36649382 | 154442377 | 117792995 | gain | 1337 | TAF7L | 2.95 | Exon + ve, 5 > ASD > 1, Normals < 2, Sanger – ve | 621 |
| 23 | 36649382 | 154442377 | 117792995 | gain | 1337 | MCART6 | 2.95 | Exon + ve, 5 > ASD > 1, Normals < 2, Sanger – ve | 621 |
| 23 | 36649382 | 154442377 | 117792995 | gain | 1337 | ZDHHC9 | 7.42 | Intron + ve, ASD > 4, Normals < 2, no Sanger filter applied | 621 |
| 23 | 36649382 | 154442377 | 117792995 | gain | 1337 | OR13H1, LOC286467 | 4.44 | Exon + ve, 5 > ASD > 1, Normals < 2, Sanger – ve | 621 |
| 23 | 36649382 | 154442377 | 117792995 | gain | 1337 | LOC286467 | 5.92 | Exon + ve, 5 > ASD > 1, Normals < 2, Sanger – ve | 621 |
| 23 | 36649382 | 154442377 | 117792995 | gain | 1337 | LOC286467 | 4.44 | Exon + ve, 5 > ASD > 1, Normals < 2, Sanger – ve | 621 |
| 23 | 36649382 | 154442377 | 117792995 | gain | 1337 | MAGEC1, MAGEC3 | 2.95 | Exon + ve, 5 > ASD > 1, Normals < 2, Sanger – ve | 621 |
| 23 | 36649382 | 154442377 | 117792995 | gain | 1337 | MIR890 | 2.95 | Exon + ve, 5 > ASD > 1, Normals < 2, Sanger – ve | 621 |
| 23 | 36649382 | 154442377 | 117792995 | gain | 1337 | TMEM185A | 5.92 | Exon + ve, 5 > ASD > 1, Normals < 2, Sanger – ve | 621 |
| 23 | 36649382 | 154442377 | 117792995 | gain | 1337 | TMEM185A | 7.42 | Intron + ve, ASD > 4, Normals < 2, no Sanger filter applied | 621 |
| 23 | 36649382 | 154442377 | 117792995 | gain | 1337 | MAGEA11 | 5.92 | Exon + ve, 5 > ASD > 1, Normals < 2, Sanger – ve | 621 |
| 23 | 36649382 | 154442377 | 117792995 | gain | 1337 | CXorf40B, LOC100272228 | 2.95 | Exon + ve, 5 > ASD > 1, Normals < 2, Sanger – ve | 621 |
| 23 | 36649382 | 154442377 | 117792995 | gain | 1337 | NSDHL | 4.44 | Exon + ve, 5 > ASD > 1, Normals < 2, Sanger – ve | 621 |
| 23 | 36649382 | 154442377 | 117792995 | gain | 1337 | L1CAM | 4.44 | Exon + ve, 5 > ASD > 1, Normals < 2, Sanger – ve | 621 |
| 23 | 36649382 | 154442377 | 117792995 | gain | 1337 | FLNA | 2.95 | Exon + ve, 5 > ASD > 1, Normals < 2, Sanger – ve | 621 |
| 23 | 36649382 | 154442377 | 117792995 | gain | 1337 | F8 | 2.95 | Exon + ve, 5 > ASD > 1, Normals < 2, Sanger – ve | 621 |
| 23 | 36649382 | 154442377 | 117792995 | gain | 1337 | TMLHE | 2.95 | Exon + ve, 5 > ASD > 1, Normals < 2, Sanger – ve | 621 |
| 23 | 37200683 | 37201899 | 1216 | gain | 2020 | PRRG1 | 4.44 | Exon + ve, 5 > ASD > 1, Normals < 2, Sanger – ve | 733 |
| 23 | 37200683 | 37201899 | 1216 | gain | 2031 | PRRG1 | 4.44 | Exon + ve, 5 > ASD > 1, Normals < 2, Sanger – ve | 733 |
| 23 | 37674337 | 37893418 | 219081 | gain | 1649 | SYTL5, CXorf27 | 2.95 | Exon + ve, 5 > ASD > 1, Normals < 2, Sanger – ve | 827 |
| 23 | 46248133 | 46295089 | 46956 | gain | 1874 | ZNF674, LOC401588 | 2.95 | Exon + ve, 5 > ASD > 1, Normals < 2, Sanger – ve | 828 |
| 23 | 48171740 | 52710629 | 4538889 | gain | 1349 | GLOD5 | 2.95 | Exon + ve, 5 > ASD > 1, Normals < 2, Sanger – ve | 829 |
| 23 | 48171740 | 52710629 | 4538889 | gain | 1349 | NUDT10, NUDT11 | 2.95 | Exon + ve, 5 > ASD > 1, Normals < 2, Sanger – ve | 829 |
| 23 | 62321946 | 52710629 | 4538889 | gain | 1646 | LOC441495,CENPVL1 | 2.95 | Exon + ve, 5 > ASD > 1, Normals < 2, Sanger – ve | 830 |
| 23 | 62321946 | 62663185 | 341239 | gain | 1646 | SPIN4, LOC92249 | 2.95 | Exon + ve, 5 > ASD > 1, Normals < 2, Sanger – ve | 830 |
| 23 | 65635181 | 65947086 | 311905 | loss | 1692 | EDA2R | 5.92 | Exon + ve, 5 > ASD > 1, Normals < 2, Sanger – ve | 662 |
| 23 | 65584935 | 65848643 | 163708 | gain | 1255 | EDA2R | 5.92 | Exon + ve, 5 > ASD > 1, Normals < 2, Sanger – ve | 661 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 23 | 65684935 | 65848643 | 163708 | gain | 1438 | EDA2R | 5.92 | Exon + ve, 5 > ASD > 1, Normals < 2, Sanger − ve | 661 |
| 23 | 73083877 | 73086192 | 2315 | loss | 1345 | NCRNA00183 | 7.42 | Intron + ve, ASD > 4, Normals < 2, no Sanger filter applied | 622 |
| 23 | 73083877 | 73086192 | 2315 | loss | 1493 | NCRNA00183 | 7.42 | Intron + ve, ASD > 4, Normals < 2, no Sanger filter applied | 622 |
| 23 | 73083877 | 73086192 | 2315 | loss | 1574 | NCRNA00183 | 7.42 | Intron + ve, ASD > 4, Normals < 2, no Sanger filter applied | 622 |
| 23 | 73083877 | 73086192 | 2315 | loss | 1856 | NCRNA00183 | 7.42 | Intron + ve, ASD > 4, Normals < 2, no Sanger filter applied | 622 |
| 23 | 76992219 | 77010018 | 17799 | gain | 1273 | MAGT1 | 5.92 | Exon + ve, 5 > ASD > 1, Normals < 2, Sanger − ve | 663 |
| 23 | 76992219 | 77010018 | 17799 | gain | 1421 | MAGT1 | 5.92 | Exon + ve, 5 > ASD > 1, Normals < 2, Sanger − ve | 663 |
| 23 | 76992219 | 76998610 | 6391 | gain | 1864 | MAGT1 | 5.92 | Exon + ve, 5 > ASD > 1, Normals < 2, Sanger − ve | 664 |
| 23 | 100409973 | 100414722 | 4749 | gain | 1862 | TAF7L | 2.95 | Exon + ve, 5 > ASD > 1, Normals < 2, Sanger − ve | 831 |
| 23 | 103224094 | 103273837 | 49743 | gain | 1424 | MCART6 | 2.95 | Exon + ve, 5 > ASD > 1, Normals < 2, Sanger − ve | 832 |
| 23 | 128768758 | 128782290 | 13532 | gain | 1806 | ZDHHC9 | 7.42 | Intron + ve, ASD > 4, Normals < 2, no Sanger filter applied | 624 |
| 23 | 128772381 | 128782290 | 9909 | gain | 1824 | ZDHHC9 | 7.42 | Intron + ve, ASD > 4, Normals < 2, no Sanger filter applied | 625 |
| 23 | 128775325 | 128780946 | 5621 | gain | 1459 | ZDHHC9 | 7.42 | Intron + ve, ASD > 4, Normals < 2, no Sanger filter applied | 623 |
| 23 | 128777108 | 128780946 | 3838 | gain | 2037 | ZDHHC9 | 7.42 | Intron + ve, ASD > 4, Normals < 2, no Sanger filter applied | 626 |
| 23 | 130480966 | 130801955 | 320989 | gain | 1771 | OR13H1, LOC286467 | 4.44 | Exon + ve, 5 > ASD > 1, Normals < 2, Sanger − ve | 666 |
| 23 | 130480966 | 130801955 | 320989 | gain | 1940 | OR13H1, LOC286467 | 4.44 | Exon + ve, 5 > ASD > 1, Normals < 2, Sanger − ve | 666 |
| 23 | 130480966 | 130801955 | 320989 | gain | 1771 | LOC286467 | 5.92 | Exon + ve, 5 > ASD > 1, Normals < 2, Sanger − ve | 666 |
| 23 | 130480966 | 130801955 | 320989 | gain | 1940 | LOC286467 | 5.92 | Exon + ve, 5 > ASD > 1, Normals < 2, Sanger − ve | 666 |
| 23 | 130480966 | 130801955 | 320989 | gain | 1464 | LOC286467 | 5.92 | Exon + ve, 5 > ASD > 1, Normals < 2, Sanger − ve | 665 |
| 23 | 130724110 | 130732350 | 8240 | gain | 1464 | LOC286467 | 5.92 | Exon + ve, 5 > ASD > 1, Normals < 2, Sanger − ve | 665 |
| 23 | 140749582 | 141011409 | 264827 | gain | 1641 | MAGEC1, MAGEC3 | 2.95 | Exon + ve, 5 > ASD > 1, Normals < 2, Sanger − ve | 833 |
| 23 | 144883013 | 144883778 | 765 | loss | 1585 | MIR890 | 2.95 | Exon + ve, 5 > ASD > 1, Normals < 2, Sanger − ve | 834 |
| 23 | 148452844 | 148694272 | 241428 | gain | 1429 | TMEM185A | 5.92 | Exon + ve, 5 > ASD > 1, Normals < 2, Sanger − ve | 627 |
| 23 | 148452844 | 148694272 | 241428 | gain | 1429 | TMEM185A | 7.42 | Intron + ve, ASD > 4, Normals < 2, no Sanger filter applied | 627 |
| 23 | 148452844 | 148694272 | 241428 | gain | 1429 | MAGEA11 | 5.92 | Exon + ve, 5 > ASD > 1, Normals < 2, Sanger − ve | 627 |
| 23 | 148456474 | 148543850 | 87376 | gain | 1967 | TMEM185A | 5.92 | Exon + ve, 5 > ASD > 1, Normals < 2, Sanger − ve | 630 |
| 23 | 148456474 | 148543850 | 87376 | gain | 1967 | TMEM185A | 7.42 | Intron + ve, ASD > 4, Normals < 2, no Sanger filter applied | 630 |
| 23 | 148491866 | 148543850 | 51984 | loss | 1873 | TMEM185A | 5.92 | Exon + ve, 5 > ASD > 1, Normals < 2, Sanger − ve | 629 |
| 23 | 148491866 | 148543850 | 51984 | loss | 1873 | TMEM185A | 7.42 | Intron + ve, ASD > 4, Normals < 2, no Sanger filter applied | 629 |
| 23 | 148512859 | 148543850 | 30991 | gain | 1739 | TMEM185A | 7.42 | Intron + ve, ASD > 4, Normals < 2, no Sanger filter applied | 628 |
| 23 | 148573318 | 148609934 | 36616 | gain | 1739 | MAGEA11 | 5.92 | Exon + ve, 5 > ASD > 1, Normals < 2, Sanger − ve | 667 |
| 23 | 148573318 | 148609934 | 36616 | gain | 1967 | MAGEA11 | 5.92 | Exon + ve, 5 > ASD > 1, Normals < 2, Sanger − ve | 667 |
| 23 | 148856479 | 149008717 | 152238 | gain | 1429 | CXorf40B, LOC100272228 | 2.95 | Exon + ve, 5 > ASD > 1, Normals < 2, Sanger − ve | 835 |
| 23 | 151730135 | 151853605 | 123470 | gain | 1887 | NSDHL | 2.95 | Exon + ve, 5 > ASD > 1, Normals < 2, Sanger − ve | 836 |
| 23 | 152787203 | 152793677 | 6474 | loss | 1820 | L1CAM | 2.95 | Exon + ve, 5 > ASD > 1, Normals < 2, Sanger − ve | 837 |
| 23 | 153232909 | 153256482 | 23573 | loss | 1907 | FLNA | 2.95 | Exon + ve, 5 > ASD > 1, Normals < 2, Sanger − ve | 838 |
| 23 | 153864652 | 153867340 | 2688 | gain | 1754 | F8 | 2.95 | Exon + ve, 5 > ASD > 1, Normals < 2, Sanger − ve | 839 |
| 23 | 154395845 | 154429912 | 34067 | loss | 1724 | TMLHE | 2.95 | Exon + ve, 5 > ASD > 1, Normals < 2, Sanger − ve | 840 |
| 23 | 154441943 | 154456908 | 14965 | loss | 1950 | TMLHE | 7.42 | Intron + ve, ASD > 4, Normals < 2, no Sanger filter applied | 634 |
| 23 | 154446801 | 154494590 | 47789 | gain | 1271 | TMLHE | 7.42 | Intron + ve, ASD > 4, Normals < 2, no Sanger filter applied | 631 |
| 23 | 154456891 | 154582414 | 125523 | gain | 1337 | TMLHE | 7.42 | Intron + ve, ASD > 4, Normals < 2, no Sanger filter applied | 632 |
| 23 | 154456891 | 154456908 | 17 | loss | 1493 | TMLHE | 7.42 | Intron + ve, ASD > 4, Normals < 2, no Sanger filter applied | 633 |
| 23 | 154456891 | 154456908 | 17 | loss | 2033 | TMLHE | 7.42 | Intron + ve, ASD > 4, Normals < 2, no Sanger filter applied | 633 |
| 29 | 278512 | 285879 | 7367 | loss | 1727 | HMX1 | 4.44 | Exon + ve, 5 > ASD > 1, Normals < 2, Sanger − ve | 385 |
| 29 | 278512 | 285879 | 7367 | loss | 1727 | HMX1 | 11.92 | Intron + ve, ASD > 4, Normals < 2, Sanger − ve | 385 |
| 29 | 279211 | 285879 | 6668 | loss | 1704 | HMX1 | 4.44 | Exon + ve, 5 > ASD > 1, Normals < 2, Sanger − ve | 383 |
| 29 | 279211 | 285879 | 6668 | loss | 1883 | HMX1 | 4.44 | Exon + ve, 5 > ASD > 1, Normals < 2, Sanger − ve | 383 |
| 29 | 279211 | 285879 | 6668 | loss | 1704 | HMX1 | 11.92 | Intron + ve, ASD > 4, Normals < 2, no Sanger Filter applied | 383 |
| 29 | 279211 | 285879 | 6668 | loss | 1883 | HMX1 | 11.92 | Intron + ve, ASD > 4, Normals < 2, no Sanger filter applied | 383 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 29 | 282241 | 285879 | 3638 | loss | 1721 | HMX1 | 11.92 | Intron + ve, ASD > 4, Normals < 2, no Sanger filter applied | 384 |
| 29 | 282241 | 287373 | 5132 | loss | 1797 | HMX1 | 11.92 | Intron + ve, ASD > 4, Normals < 2, no Sanger filter applied | 386 |
| 29 | 282241 | 285879 | 3638 | loss | 1874 | HMX1 | 11.92 | Intron + ve, ASD > 4, Normals < 2, no Sanger filter applied | 384 |
| 29 | 282241 | 285879 | 3638 | loss | 1955 | HMX1 | 11.92 | Intron + ve, ASD > 4, Normals < 2, no Sanger filter applied | 384 |
| 29 | 282241 | 285879 | 3638 | loss | 1958 | HMX1 | 11.92 | Intron + ve, ASD > 4, Normals < 2, no Sanger filter applied | 384 |
| 34 | 583370 | 1141964 | 558594 | loss | 1244 | C9orf69, RNF208 | 31.25 | Genic (distinct CNV-subregions); OR > 6 | 206 |
| 34 | 583370 | 1141964 | 558594 | gain | 1309 | C9orf69, RNF208 | 31.25 | Genic (distinct CNV-subregions); OR > 6 | 206 |
| 34 | 583370 | 1141964 | 558594 | gain | 1320 | C9orf69, RNF208 | 31.25 | Genic (distinct CNV-subregions); OR > 6 | 206 |
| 34 | 583370 | 1141964 | 558594 | gain | 1493 | C9orf69, RNF208 | 31.25 | Genic (distinct CNV-subregions); OR > 6 | 206 |
| 34 | 583370 | 1141964 | 558594 | gain | 1541 | C9orf69, RNF208 | 31.25 | Genic (distinct CNV-subregions); OR > 6 | 206 |
| 34 | 583370 | 1141964 | 558594 | gain | 1542 | C9orf69, RNF208 | 31.25 | Genic (distinct CNV-subregions); OR > 6 | 206 |
| 34 | 583370 | 1141964 | 558594 | gain | 1543 | C9orf69, RNF208 | 31.25 | Genic (distinct CNV-subregions); OR > 6 | 206 |
| 34 | 583370 | 1141964 | 558594 | gain | 1560 | C9orf69, RNF208 | 31.25 | Genic (distinct CNV-subregions); OR > 6 | 206 |
| 34 | 583370 | 1141964 | 558594 | gain | 1570 | C9orf69, RNF208 | 31.25 | Genic (distinct CNV-subregions); OR > 6 | 206 |
| 34 | 583370 | 1141964 | 558594 | gain | 1585 | C9orf69, RNF208 | 31.25 | Genic (distinct CNV-subregions); OR > 6 | 206 |
| 34 | 583370 | 1141964 | 558594 | gain | 1587 | C9orf69, RNF208 | 31.25 | Genic (distinct CNV-subregions); OR > 6 | 206 |
| 34 | 583370 | 1141964 | 558594 | gain | 1588 | C9orf69, RNF208 | 31.25 | Genic (distinct CNV-subregions); OR > 6 | 206 |
| 34 | 583370 | 1141964 | 558594 | gain | 1589 | C9orf69, RNF208 | 31.25 | Genic (distinct CNV-subregions); OR > 6 | 206 |
| 34 | 583370 | 1141964 | 558594 | gain | 1605 | C9orf69, RNF208 | 31.25 | Genic (distinct CNV-subregions); OR > 6 | 206 |
| 34 | 583370 | 1141964 | 558594 | gain | 1606 | C9orf69, RNF208 | 31.25 | Genic (distinct CNV-subregions); OR > 6 | 206 |
| 34 | 583370 | 1141964 | 558594 | loss | 1718 | C9orf69, RNF208 | 31.25 | Genic (distinct CNV-subregions); OR > 6 | 206 |
| 34 | 583370 | 1141964 | 558594 | loss | 1737 | C9orf69, RNF208 | 31.25 | Genic (distinct CNV-subregions); OR > 6 | 206 |
| 34 | 583370 | 1141964 | 558594 | loss | 1741 | C9orf69, RNF208 | 31.25 | Genic (distinct CNV-subregions); OR > 6 | 206 |
| 34 | 583370 | 1141964 | 558594 | loss | 1743 | C9orf69, RNF208 | 31.25 | Genic (distinct CNV-subregions); OR > 6 | 206 |
| 34 | 583370 | 1141964 | 558594 | loss | 1757 | C9orf69, RNF208 | 31.25 | Genic (distinct CNV-subregions); OR > 6 | 206 |
| 34 | 583370 | 1141964 | 558594 | loss | 1800 | C9orf69, RNF208 | 31.25 | Genic (distinct CNV-subregions); OR > 6 | 206 |
| 34 | 583370 | 1141964 | 558594 | loss | 1816 | C9orf69, RNF208 | 31.25 | Genic (distinct CNV-subregions); OR > 6 | 206 |
| 34 | 583370 | 1141964 | 558594 | loss | 1856 | C9orf69, RNF208 | 31.25 | Genic (distinct CNV-subregions); OR > 6 | 206 |
| 34 | 583370 | 1141964 | 558594 | loss | 1859 | C9orf69, RNF208 | 31.25 | Genic (distinct CNV-subregions); OR > 6 | 206 |
| 34 | 583370 | 1141964 | 558594 | gain | 1861 | C9orf69, RNF208 | 31.25 | Genic (distinct CNV-subregions); OR > 6 | 206 |
| 34 | 583370 | 1141964 | 558594 | gain | 1862 | C9orf69, RNF208 | 31.25 | Genic (distinct CNV-subregions); OR > 6 | 206 |
| 34 | 583370 | 1141964 | 558594 | loss | 1868 | C9orf69, RNF208 | 31.25 | Genic (distinct CNV-subregions); OR > 6 | 206 |
| 34 | 583370 | 1141964 | 558594 | loss | 1919 | C9orf69, RNF208 | 31.25 | Genic (distinct CNV-subregions); OR > 6 | 206 |
| 34 | 583370 | 1141964 | 558594 | loss | 1921 | C9orf69, RNF208 | 31.25 | Genic (distinct CNV-subregions); OR > 6 | 206 |
| 34 | 583370 | 1141964 | 558594 | loss | 1935 | C9orf69, RNF208 | 31.25 | Genic (distinct CNV-subregions); OR > 6 | 206 |
| 34 | 583370 | 1141964 | 558594 | loss | 1940 | C9orf69, RNF208 | 31.25 | Genic (distinct CNV-subregions); OR > 6 | 206 |
| 34 | 583370 | 1141964 | 558594 | loss | 1942 | C9orf69, RNF208 | 31.25 | Genic (distinct CNV-subregions); OR > 6 | 206 |
| 34 | 583370 | 1141964 | 558594 | loss | 1957 | C9orf69, RNF208 | 31.25 | Genic (distinct CNV-subregions); OR > 6 | 206 |
| 34 | 583370 | 1141964 | 558594 | loss | 1966 | C9orf69, RNF208 | 31.25 | Genic (distinct CNV-subregions); OR > 6 | 206 |
| 34 | 583370 | 1141964 | 558594 | loss | 1969 | C9orf69, RNF208 | 31.25 | Genic (distinct CNV-subregions); OR > 6 | 206 |
| 34 | 583370 | 1141964 | 558594 | loss | 2003 | C9orf69, RNF208 | 31.25 | Genic (distinct CNV-subregions); OR > 6 | 206 |
| 34 | 583370 | 1141964 | 558594 | loss | 2004 | C9orf69, RNF208 | 31.25 | Genic (distinct CNV-subregions); OR > 6 | 206 |
| 34 | 583370 | 1141964 | 558594 | loss | 2005 | C9orf69, RNF208 | 31.25 | Genic (distinct CNV-subregions); OR > 6 | 206 |
| 34 | 583370 | 1141964 | 558594 | loss | 2018 | C9orf69, RNF208 | 31.25 | Genic (distinct CNV-subregions); OR > 6 | 206 |
| 34 | 583370 | 1141964 | 558594 | loss | 2035 | C9orf69, RNF208 | 31.25 | Genic (distinct CNV-subregions); OR > 6 | 206 |
| 40 | 53140 | 687577 | 687577 | gain | 1477 | LOC727849, LOC80154, LOC440297 | 4.44 | Exon + ve, 5 > ASD > 1, Normals < 2, Sanger − ve | 734 |
| 40 | 53140 | 744689 | 691549 | gain | 1541 | LOC727849, LOC80154, LOC440297 | 4.44 | Exon + ve, 5 > ASD > 1, Normals < 2, Sanger − ve | 735 |
| 40 | 53140 | 741444 | 688304 | loss | 2022 | LOC727849, LOC80154, LOC440297 | 4.44 | Exon + ve, 5 > ASD > 1, Normals < 2, Sanger − ve | 736 |

TABLE 1-continued

| Chr | Original CNV Start | Original CNV Stop | Original CNV Size | CNVType | ASD Case ID(s) | RefSeq Gene Symbol(s) | OR | Category | SEQ ID NO |
|---|---|---|---|---|---|---|---|---|---|
| 42 | 86934 | 405510 | 318576 | gain | 1391 | KRT39, KRTAP1-1, KRTAP1-3, KRTAP1-5, KRTAP2-2, KRTAP2-1, KRTAP3-2, KRTAP3-3, KRTAP2-4, KRT40, KRTAP4-11, KRTAP3-1, KRTAP4-12, LOC730755 | 4.44 | Exon + ve, 5 > ASD > 1, Normals < 2, Sanger − ve | 737 |
| 42 | 86934 | 405510 | 318576 | gain | 1559 | KRT39, KRTAP1-1, KRTAP1-3, KRTAP1-5, KRTAP2-2, KRTAP2-1, KRTAP3-2, KRTAP3-3, KRTAP2-4, KRT40, KRTAP4-11, KRTAP3-1, KRTAP4-12, LOC730755 | 4.44 | Exon + ve, 5 > ASD > 1, Normals < 2, Sanger − ve | 737 |
| 42 | 107381 | 663922 | 556541 | gain | 1836 | KRT39, KRTAP1-1, KRTAP1-3, KRTAP1-5, KRTAP2-2, KRTAP2-1, KRTAP3-2, KRTAP3-3, KRTAP2-4, KRT40, KRTAP4-11, KRTAP3-1, KRTAP4-12, LOC730755 | 4.44 | Exon + ve, 5 > ASD > 1, Normals < 2, Sanger − ve | 738 |
| 42 | 2174372 | 2614478 | 440106 | loss | 1223 | PYCR1, LOC92659 | 2.95 | Exon + ve, 5 > ASD > 1, Normals < 2, Sanger − ve | 668 |
| 42 | 2174372 | 2614478 | 440106 | loss | 1872 | PYCR1, LOC92659 | 2.95 | Exon + ve, 5 > ASD > 1, Normals < 2, Sanger − ve | 668 |
| 42 | 2174372 | 2614478 | 440106 | loss | 1223 | GCGR | 4.44 | Exon + ve, 5 > ASD > 1, Normals < 2, Sanger − ve | 668 |
| 42 | 2174372 | 2614478 | 440106 | loss | 1872 | GCGR | 4.44 | Exon + ve, 5 > ASD > 1, Normals < 2, Sanger − ve | 668 |
| 42 | 2174372 | 2614478 | 440106 | loss | 1223 | FAM195B | 5.92 | Exon + ve, 5 > ASD > 1, Normals < 2, Sanger − ve | 668 |
| 42 | 2174372 | 2614478 | 440106 | loss | 1872 | FAM195B | 5.92 | Exon + ve, 5 > ASD > 1, Normals < 2, Sanger − ve | 668 |
| 42 | 2174372 | 2614478 | 204057 | loss | 1727 | GCGR | 4.44 | Exon + ve, 5 > ASD > 1, Normals < 2, Sanger − ve | 669 |
| 42 | 2319521 | 2614478 | 294957 | loss | 1727 | FAM195B | 5.92 | Exon + ve, 5 > ASD > 1, Normals < 2, Sanger − ve | 669 |
| 42 | 2332710 | 2614478 | 281768 | gain | 1891 | FAM195B | 5.92 | Exon + ve, 5 > ASD > 1, Normals < 2, Sanger − ve | 670 |

TABLE 2

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 1 | 1 | 750052 | 770858 | 20,806 | loss | 1229 | LOC643837, NCRNA00115 | Y | 1 | 6 | 8.91 | Exon+ve, ASD > 4, Normals < 2, no Sanger filter applied |
| 1 | 1 | 750052 | 770858 | 20,806 | gain | 1252 | LOC643837, NCRNA00115 | Y | 1 | 6 | 8.91 | Exon+ve, ASD > 4, Normals < 2, no Sanger filter applied |
| 1 | 1 | 750052 | 770858 | 20,806 | gain | 1742 | LOC643837, NCRNA00115 | Y | 1 | 6 | 8.91 | Exon+ve, ASD > 4, Normals < 2, no Sanger filter applied |
| 1 | 1 | 755052 | 770858 | 20,806 | gain | 1811 | LOC643837, NCRNA00115 | Y | 1 | 6 | 8.91 | Exon+ve, ASD > 4, Normals < 2, no Sanger filter applied |
| 1 | 1 | 750052 | 770858 | 20,806 | gain | 1837 | LOC643837, NCRNA00115 | Y | 1 | 6 | 8.91 | Exon+ve, ASD > 4, Normals < 2, no Sanger filter applied |
| 1 | 1 | 750052 | 770858 | 20,806 | gain | 1900 | LOC643837, NCRNA00115 | Y | 1 | 6 | 8.91 | Exon+ve, ASD > 4, Normals < 2, no Sanger filter applied |
| 1 | 2 | 777694 | 783568 | 5,874 | gain | 1252 | LOC643837 | Y | 1 | 5 | 7.42 | Exon+ve, ASD > 4, Normals < 2, no Sanger filter applied |
| 1 | 2 | 777694 | 783568 | 5,874 | gain | 1742 | LOC643837 | Y | 1 | 5 | 7.42 | Exon+ve, ASD > 4, Normals < 2, no Sanger filter applied |
| 1 | 2 | 777694 | 783568 | 5,874 | gain | 1811 | LOC643837 | Y | 1 | 5 | 7.42 | Exon+ve, ASD > 4, Normals < 2, no Sanger filter applied |
| 1 | 2 | 777694 | 783568 | 5,874 | gain | 1837 | LOC643837 | Y | 1 | 5 | 7.42 | Exon+ve, ASD > 4, Normals < 2, no Sanger filter applied |
| 1 | 2 | 777694 | 783568 | 5,874 | gain | 1900 | LOC643837 | Y | 1 | 5 | 7.42 | Exon+ve, ASD > 4, Normals < 2, no Sanger filter applied |
| 1 | 3 | 9769722 | 9772801 | 3,079 | loss | 1301 | CLSTN1 | N | 1 | 14 | 21.04 | Intron+ve, ASD > 4, Normals < 2, no Sanger filter applied |
| 1 | 3 | 9769722 | 9772801 | 3,079 | loss | 1474 | CLSTN1 | N | 1 | 14 | 21.04 | Intron+ve, ASD > 4, Normals < 2, no Sanger filter applied |
| 1 | 3 | 9769722 | 9772801 | 3,079 | loss | 1487 | CLSTN1 | N | 1 | 14 | 21.04 | Intron+ve, ASD > 4, Normals < 2, no Sanger filter applied |
| 1 | 3 | 9769722 | 9772801 | 3,079 | loss | 1533 | CLSTN1 | N | 1 | 14 | 21.04 | Intron+ve, ASD > 4, Normals < 2, no Sanger filter applied |
| 1 | 3 | 9769722 | 9772801 | 3,079 | loss | 1536 | CLSTN1 | N | 1 | 14 | 21.04 | Intron+ve, ASD > 4, Normals < 2, no Sanger filter applied |
| 1 | 3 | 9769722 | 9772801 | 3,079 | loss | 1546 | CLSTN1 | N | 1 | 14 | 21.04 | Intron+ve, ASD > 4, Normals < 2, no Sanger filter applied |
| 1 | 3 | 9769722 | 9772801 | 3,079 | loss | 1551 | CLSTN1 | N | 1 | 14 | 21.04 | Intron+ve, ASD > 4, Normals < 2, no Sanger filter applied |
| 1 | 3 | 9769722 | 9772801 | 3,079 | loss | 1573 | CLSTN1 | N | 1 | 14 | 21.04 | Intron+ve, ASD > 4, Normals < 2, no Sanger filter applied |
| 1 | 3 | 9769722 | 9772801 | 3,079 | loss | 1602 | CLSTN1 | N | 1 | 14 | 21.04 | Intron+ve, ASD > 4, Normals < 2, no Sanger filter applied |
| 1 | 3 | 9769722 | 9772801 | 3,079 | loss | 1648 | CLSTN1 | N | 1 | 14 | 21.04 | Intron+ve, ASD > 4, Normals < 2, no Sanger filter applied |
| 1 | 3 | 9769722 | 9772801 | 3,079 | loss | 1658 | CLSTN1 | N | 1 | 14 | 21.04 | Intron+ve, ASD > 4, Normals < 2, no Sanger filter applied |
| 1 | 3 | 9769722 | 9772801 | 3,079 | loss | 1734 | CLSTN1 | N | 1 | 14 | 21.04 | Intron+ve, ASD > 4, Normals < 2, no Sanger filter applied |
| 1 | 3 | 9769722 | 9772801 | 3,079 | loss | 1740 | CLSTN1 | N | 1 | 14 | 21.04 | Intron+ve, ASD > 4, Normals < 2, no Sanger filter applied |
| 1 | 3 | 9769722 | 9772801 | 3,079 | loss | 1923 | CLSTN1 | N | 1 | 14 | 21.04 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 1 | 4 | 9772802 | 9776903 | 4,101 | loss | 1301 | CLSTN1 | N | 1 | 15 | 22.58 | Intron+ve, ASD > 4, Normals < 2, no Sanger filter applied |
| 1 | 4 | 9772802 | 9776903 | 4,101 | loss | 1436 | CLSTN1 | N | 1 | 15 | 22.58 | Intron+ve, ASD > 4, Normals < 2, no Sanger filter applied |
| 1 | 4 | 9772802 | 9776903 | 4,101 | loss | 1474 | CLSTN1 | N | 1 | 15 | 22.58 | Intron+ve, ASD > 4, Normals < 2, no Sanger filter applied |
| 1 | 4 | 9772802 | 9776903 | 4,101 | loss | 1487 | CLSTN1 | N | 1 | 15 | 22.58 | Intron+ve, ASD > 4, Normals < 2, no Sanger filter applied |
| 1 | 4 | 9772802 | 9776903 | 4,101 | loss | 1533 | CLSTN1 | N | 1 | 15 | 22.58 | Intron+ve, ASD > 4, Normals < 2, no Sanger filter applied |
| 1 | 4 | 9772802 | 9776903 | 4,101 | loss | 1536 | CLSTN1 | N | 1 | 15 | 22.58 | Intron+ve, ASD > 4, Normals < 2, no Sanger filter applied |
| 1 | 4 | 9772802 | 9776903 | 4,101 | loss | 1546 | CLSTN1 | N | 1 | 15 | 22.58 | Intron+ve, ASD > 4, Normals < 2, no Sanger filter applied |
| 1 | 4 | 9772802 | 9776903 | 4,101 | loss | 1551 | CLSTN1 | N | 1 | 15 | 22.58 | Intron+ve, ASD > 4, Normals < 2, no Sanger filter applied |
| 1 | 4 | 9772802 | 9776903 | 4,101 | loss | 1573 | CLSTN1 | N | 1 | 15 | 22.58 | Intron+ve, ASD > 4, Normals < 2, no Sanger filter applied |
| 1 | 4 | 9772802 | 9776903 | 4,101 | loss | 1602 | CLSTN1 | N | 1 | 15 | 22.58 | Intron+ve, ASD > 4, Normals < 2, no Sanger filter applied |
| 1 | 4 | 9772802 | 9776903 | 4,101 | loss | 1648 | CLSTN1 | N | 1 | 15 | 22.58 | Intron+ve, ASD > 4, Normals < 2, no Sanger filter applied |
| 1 | 4 | 9772802 | 9776903 | 4,101 | loss | 1658 | CLSTN1 | N | 1 | 15 | 22.58 | Intron+ve, ASD > 4, Normals < 2, no Sanger filter applied |
| 1 | 4 | 9772802 | 9776903 | 4,101 | loss | 1734 | CLSTN1 | N | 1 | 15 | 22.58 | Intron+ve, ASD > 4, Normals < 2, no Sanger filter applied |
| 1 | 4 | 9772802 | 9776903 | 4,101 | loss | 1740 | CLSTN1 | N | 1 | 15 | 22.58 | Intron+ve, ASD > 4, Normals < 2, no Sanger filter applied |
| 1 | 4 | 9772802 | 9776903 | 4,101 | loss | 1923 | CLSTN1 | N | 1 | 15 | 22.58 | Intron+ve, ASD > 4, Normals < 2, no Sanger filter applied |
| 1 | 5 | 17148593 | 17154037 | 5,444 | loss | 1256 | CROCC | Y | 1 | 9 | 13.43 | Exon+ve, ASD > 4, Normals < 2, no Sanger filter applied |
| 1 | 5 | 17148593 | 17154037 | 5,444 | gain | 1501 | CROCC | Y | 1 | 9 | 13.43 | Exon+ve, ASD > 4, Normals < 2, no Sanger filter applied |
| 1 | 5 | 17148593 | 17154037 | 5,444 | loss | 1658 | CROCC | Y | 1 | 9 | 13.43 | Exon+ve, ASD > 4, Normals < 2, no Sanger filter applied |
| 1 | 5 | 17148593 | 17154037 | 5,444 | loss | 1673 | CROCC | Y | 1 | 9 | 13.43 | Exon+ve, ASD > 4, Normals < 2, no Sanger filter applied |
| 1 | 5 | 17148593 | 17154037 | 5,444 | loss | 1677 | CROCC | Y | 1 | 9 | 13.43 | Exon+ve, ASD > 4, Normals < 2, no Sanger filter applied |
| 1 | 5 | 17148593 | 17154037 | 5,444 | loss | 1694 | CROCC | Y | 1 | 9 | 13.43 | Exon+ve, ASD > 4, Normals < 2, no Sanger filter applied |
| 1 | 5 | 17148593 | 17154037 | 5,444 | loss | 1905 | CROCC | Y | 1 | 9 | 13.43 | Exon+ve, ASD > 4, Normals < 2, no Sanger filter applied |
| 1 | 5 | 17148593 | 17154037 | 5,444 | loss | 1947 | CROCC | Y | 1 | 9 | 13.43 | Exon+ve, ASD > 4, Normals < 2, no Sanger filter applied |
| 1 | 5 | 17148593 | 17154037 | 5,444 | loss | 1949 | CROCC | Y | 1 | 9 | 13.43 | Exon+ve, ASD > 4, Normals < 2, no Sanger filter applied |
| 1 | 6 | 31762404 | 31764282 | 1,878 | loss | 1405 | LOC284551 | Y | 2 | 14 | 10.51 | Genic (distinct CNV-subregions); OR > 6 |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 1 | 6 | 31762404 | 31764282 | 1,878 | loss | 1508 | LOC284551 | Y | 2 | 14 | 10.51 | Genic (distinct CNV-subregions); OR > 6 |
| 1 | 6 | 31762404 | 31764282 | 1,878 | loss | 1513 | LOC284551 | Y | 2 | 14 | 10.51 | Genic (distinct CNV-subregions); OR > 6 |
| 1 | 6 | 31762404 | 31764282 | 1,878 | loss | 1527 | LOC284551 | Y | 2 | 14 | 10.51 | Genic (distinct CNV-subregions); OR > 6 |
| 1 | 6 | 31762404 | 31764282 | 1,878 | loss | 1557 | LOC284551 | Y | 2 | 14 | 10.51 | Genic (distinct CNV-subregions); OR > 6 |
| 1 | 6 | 31762404 | 31764282 | 1,878 | loss | 1583 | LOC284551 | Y | 2 | 14 | 10.51 | Genic (distinct CNV-subregions); OR > 6 |
| 1 | 6 | 31762404 | 31764282 | 1,878 | loss | 1617 | LOC284551 | Y | 2 | 14 | 10.51 | Genic (distinct CNV-subregions); OR > 6 |
| 1 | 6 | 31762404 | 31764282 | 1,878 | loss | 1628 | LOC284551 | Y | 2 | 14 | 10.51 | Genic (distinct CNV-subregions); OR > 6 |
| 1 | 6 | 31762404 | 31764282 | 1,878 | loss | 1644 | LOC284551 | Y | 2 | 14 | 10.51 | Genic (distinct CNV-subregions); OR > 6 |
| 1 | 6 | 31762404 | 31764282 | 1,878 | loss | 1647 | LOC284551 | Y | 2 | 14 | 10.51 | Genic (distinct CNV-subregions); OR > 6 |
| 1 | 6 | 31762404 | 31764282 | 1,878 | loss | 1696 | LOC284551 | Y | 2 | 14 | 10.51 | Genic (distinct CNV-subregions); OR > 6 |
| 1 | 6 | 31762404 | 31764282 | 1,878 | loss | 1811 | LOC284551 | Y | 2 | 14 | 10.51 | Genic (distinct CNV-subregions); OR > 6 |
| 1 | 6 | 31762404 | 31764282 | 1,878 | loss | 1836 | LOC284551 | Y | 2 | 14 | 10.51 | Genic (distinct CNV-subregions); OR > 6 |
| 1 | 6 | 31762404 | 31764282 | 1,878 | loss | 1908 | LOC284551 | Y | 2 | 14 | 10.51 | Genic (distinct CNV-subregions); OR > 6 |
| 1 | 7 | 34883376 | 34884849 | 1,473 | loss | 1239 | | N | 0 | 20 | 30.33 | high OR intergenic (OR > 30) |
| 1 | 7 | 34883376 | 34884849 | 1,473 | loss | 1253 | | N | 0 | 20 | 30.33 | high OR intergenic (OR > 30) |
| 1 | 7 | 34883376 | 34884849 | 1,473 | loss | 1291 | | N | 0 | 20 | 30.33 | high OR intergenic (OR > 30) |
| 1 | 7 | 34883376 | 34884849 | 1,473 | loss | 1347 | | N | 0 | 20 | 30.33 | high OR intergenic (OR > 30) |
| 1 | 7 | 34883376 | 34884849 | 1,473 | loss | 1439 | | N | 0 | 20 | 30.33 | high OR intergenic (OR > 30) |
| 1 | 7 | 34883376 | 34884849 | 1,473 | loss | 1455 | | N | 0 | 20 | 30.33 | high OR intergenic (OR > 30) |
| 1 | 7 | 34883376 | 34884849 | 1,473 | loss | 1474 | | N | 0 | 20 | 30.33 | high OR intergenic (OR > 30) |
| 1 | 7 | 34883376 | 34884849 | 1,473 | loss | 1492 | | N | 0 | 20 | 30.33 | high OR intergenic (OR > 30) |
| 1 | 7 | 34883376 | 34884849 | 1,473 | loss | 1511 | | N | 0 | 20 | 30.33 | high OR intergenic (OR > 30) |
| 1 | 7 | 34883376 | 34884849 | 1,473 | loss | 1564 | | N | 0 | 20 | 30.33 | high OR intergenic (OR > 30) |
| 1 | 7 | 34883376 | 34884849 | 1,473 | loss | 1598 | | N | 0 | 20 | 30.33 | high OR intergenic (OR > 30) |
| 1 | 7 | 34883376 | 34884849 | 1,473 | loss | 1601 | | N | 0 | 20 | 30.33 | high OR intergenic (OR > 30) |
| 1 | 7 | 34883376 | 34884849 | 1,473 | loss | 1641 | | N | 0 | 20 | 30.33 | high OR intergenic (OR > 30) |
| 1 | 7 | 34883376 | 34884849 | 1,473 | loss | 1643 | | N | 0 | 20 | 30.33 | high OR intergenic (OR > 30) |
| 1 | 7 | 34883376 | 34884849 | 1,473 | loss | 1646 | | N | 0 | 20 | 30.33 | high OR intergenic (OR > 30) |
| 1 | 7 | 34883376 | 34884849 | 1,473 | loss | 1717 | | N | 0 | 20 | 30.33 | high OR intergenic (OR > 30) |
| 1 | 7 | 34883376 | 34884849 | 1,473 | loss | 1786 | | N | 0 | 20 | 30.33 | high OR intergenic (OR > 30) |
| 1 | 7 | 34883376 | 34884849 | 1,473 | loss | 1827 | | N | 0 | 20 | 30.33 | high OR intergenic (OR > 30) |
| 1 | 7 | 34883376 | 34884849 | 1,473 | loss | 1928 | | N | 0 | 20 | 30.33 | high OR intergenic (OR > 30) |
| 1 | 7 | 34883376 | 34884849 | 1,473 | loss | 2005 | | N | 0 | 20 | 30.33 | high OR intergenic (OR > 30) |
| 1 | 8 | 54866507 | 54876067 | 9,560 | loss | 1668 | ACOT11 | Y | 1 | 7 | 10.41 | Exon+ve, ASD > 4, Normals < 2, no Sanger filter applied |
| 1 | 8 | 54866507 | 54876067 | 9,560 | loss | 1677 | ACOT11 | Y | 1 | 7 | 10.41 | Exon+ve, ASD > 4, Normals < 2, no Sanger filter applied |
| 1 | 8 | 54866507 | 54876067 | 9,560 | loss | 1721 | ACOT11 | Y | 1 | 7 | 10.41 | Exon+ve, ASD > 4, Normals < 2, no Sanger filter applied |
| 1 | 8 | 54866507 | 54876067 | 9,560 | loss | 1729 | ACOT11 | Y | 1 | 7 | 10.41 | Exon+ve, ASD > 4, Normals < 2, no Sanger filter applied |
| 1 | 8 | 54866507 | 54876067 | 9,560 | loss | 1908 | ACOT11 | Y | 1 | 7 | 10.41 | Exon+ve, ASD > 4, Normals < 2, no Sanger filter applied |
| 1 | 8 | 54866507 | 54876067 | 9,560 | loss | 1915 | ACOT11 | Y | 1 | 7 | 10.41 | Exon+ve, ASD > 4, Normals < 2, no Sanger filter applied |
| 1 | 8 | 54866507 | 54876067 | 9,560 | loss | 2028 | ACOT11 | Y | 1 | 7 | 10.41 | Exon+ve, ASD > 4, Normals < 2, no Sanger filter applied |
| 1 | 9 | 68435695 | 68436445 | 750 | loss | 1259 | WLS | N | 0 | 11 | 16.46 | Intron+ve, ASD > 4, Normals < 2, no Sanger filter applied |
| 1 | 9 | 68435695 | 68436445 | 750 | loss | 1267 | WLS | N | 0 | 11 | 16.46 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 1 | 9 | 68435695 | 68436445 | 750 | loss | 1344 | WLS | N | 0 | 11 | 16.46 | Intron+ve, ASD > 4, Normals < 2, no Sanger filter applied |
| 1 | 9 | 68435695 | 68436445 | 750 | loss | 1345 | WLS | N | 0 | 11 | 16.46 | Intron+ve, ASD > 4, Normals < 2, no Sanger filter applied |
| 1 | 9 | 68435695 | 68436445 | 750 | loss | 1510 | WLS | N | 0 | 11 | 16.46 | Intron+ve, ASD > 4, Normals < 2, no Sanger filter applied |
| 1 | 9 | 68435695 | 68436445 | 750 | loss | 1563 | WLS | N | 0 | 11 | 16.46 | Intron+ve, ASD > 4, Normals < 2, no Sanger filter applied |
| 1 | 9 | 68435695 | 68436445 | 750 | loss | 1594 | WLS | N | 0 | 11 | 16.46 | Intron+ve, ASD > 4, Normals < 2, no Sanger filter applied |
| 1 | 9 | 68435695 | 68436445 | 750 | loss | 1640 | WLS | N | 0 | 11 | 16.46 | Intron+ve, ASD > 4, Normals < 2, no Sanger filter applied |
| 1 | 9 | 68435695 | 68436445 | 750 | loss | 1750 | WLS | N | 0 | 11 | 16.46 | Intron+ve, ASD > 4, Normals < 2, no Sanger filter applied |
| 1 | 9 | 68435695 | 68436445 | 750 | loss | 1826 | WLS | N | 0 | 11 | 16.46 | Intron+ve, ASD > 4, Normals < 2, no Sanger filter applied |
| 1 | 9 | 68435695 | 68436445 | 750 | loss | 1852 | WLS | N | 0 | 11 | 16.46 | Intron+ve, ASD > 4, Normals < 2, no Sanger filter applied |
| 1 | 10 | 71091004 | 71094314 | 3,310 | loss | 1739 | PTGER3 | Y | 1 | 4 | 5.92 | Exon+ve, 5 > ASD > 1, Normals < 2, Sanger−ve |
| 1 | 10 | 71091004 | 71094314 | 3,310 | loss | 1802 | PTGER3 | Y | 1 | 4 | 5.92 | Exon+ve, 5 > ASD > 1, Normals < 2, Sanger−ve |
| 1 | 10 | 71091004 | 71094314 | 3,310 | loss | 1837 | PTGER3 | Y | 1 | 4 | 5.92 | Exon+ve, 5 > ASD > 1, Normals < 2, Sanger−ve |
| 1 | 10 | 71091004 | 71094314 | 3,310 | loss | 1844 | PTGER3 | Y | 1 | 4 | 5.92 | Exon+ve, 5 > ASD > 1, Normals < 2, Sanger−ve |
| 1 | 10 | 71106139 | 71113670 | 7,531 | gain | 1259 | PTGER3 | Y | 1 | 2 | 2.95 | Exon+ve, 5 > ASD > 1, Normals < 2, Sanger−ve |
| 1 | 10 | 71106139 | 71113670 | 7,531 | gain | 2041 | PTGER3 | Y | 1 | 2 | 2.95 | Exon+ve, 5 > ASD > 1, Normals < 2, Sanger−ve |
| 1 | 11 | 102231556 | 102237620 | 6,064 | loss | 1284 | OLFM3 | Y | 1 | 2 | 2.95 | Exon+ve, 5 > ASD > 1, Normals < 2, Sanger−ve |
| 1 | 11 | 102231556 | 102237620 | 6,064 | loss | 1862 | OLFM3 | Y | 1 | 2 | 2.95 | Exon+ve, 5 > ASD > 1, Normals < 2, Sanger−ve |
| 1 | 12 | 103904723 | 103906463 | 1,740 | gain | 1317 | AMY2B | N | 1 | 5 | 7.42 | Intron+ve, ASD > 4, Normals < 2, no Sanger filter applied |
| 1 | 12 | 103904723 | 103906463 | 1,740 | gain | 1567 | AMY2B | N | 1 | 5 | 7.42 | Intron+ve, ASD > 4, Normals < 2, no Sanger filter applied |
| 1 | 12 | 103904723 | 103906463 | 1,740 | gain | 1955 | AMY2B | N | 1 | 5 | 7.42 | Intron+ve, ASD > 4, Normals < 2, no Sanger filter applied |
| 1 | 12 | 103904723 | 103906463 | 1,740 | gain | 1991 | AMY2B | N | 1 | 5 | 7.42 | Intron+ve, ASD > 4, Normals < 2, no Sanger filter applied |
| 1 | 12 | 103904723 | 103906463 | 1,740 | gain | 2032 | AMY2B | N | 1 | 5 | 7.42 | Intron+ve, ASD > 4, Normals < 2, no Sanger filter applied |
| 1 | 13 | 105909960 | 105917568 | 7,608 | loss | 1250 | | N | 0 | 30 | 46.2 | high OR intergenic (OR > 30) |
| 1 | 13 | 105909960 | 105917568 | 7,608 | loss | 1253 | | N | 0 | 30 | 46.2 | high OR intergenic (OR > 30) |
| 1 | 13 | 105909960 | 105917568 | 7,608 | loss | 1287 | | N | 0 | 30 | 46.2 | high OR intergenic (OR > 30) |
| 1 | 13 | 105909960 | 105917568 | 7,608 | loss | 1324 | | N | 0 | 30 | 46.2 | high OR intergenic (OR > 30) |
| 1 | 13 | 105909960 | 105917568 | 7,608 | loss | 1337 | | N | 0 | 30 | 46.2 | high OR intergenic (OR > 30) |
| 1 | 13 | 105909960 | 105917568 | 7,608 | gain | 1410 | | N | 0 | 30 | 46.2 | high OR intergenic (OR > 30) |
| 1 | 13 | 105909960 | 105917568 | 7,608 | loss | 1416 | | N | 0 | 30 | 46.2 | high OR intergenic (OR > 30) |
| 1 | 13 | 105909960 | 105917568 | 7,608 | loss | 1494 | | N | 0 | 30 | 46.2 | high OR intergenic (OR > 30) |
| 1 | 13 | 105909960 | 105917568 | 7,608 | loss | 1502 | | N | 0 | 30 | 46.2 | high OR intergenic (OR > 30) |
| 1 | 13 | 105909960 | 105917568 | 7,608 | loss | 1515 | | N | 0 | 30 | 46.2 | high OR intergenic (OR > 30) |
| 1 | 13 | 105909960 | 105917568 | 7,608 | gain | 1521 | | N | 0 | 30 | 46.2 | high OR intergenic (OR > 30) |
| 1 | 13 | 105909960 | 105917568 | 7,608 | loss | 1557 | | N | 0 | 30 | 46.2 | high OR intergenic (OR > 30) |
| 1 | 13 | 105909960 | 105917568 | 7,608 | loss | 1558 | | N | 0 | 30 | 46.2 | high OR intergenic (OR > 30) |
| 1 | 13 | 105909960 | 105917568 | 7,608 | loss | 1564 | | N | 0 | 30 | 46.2 | high OR intergenic (OR > 30) |
| 1 | 13 | 105909960 | 105917568 | 7,608 | loss | 1566 | | N | 0 | 30 | 46.2 | high OR intergenic (OR > 30) |
| 1 | 13 | 105909960 | 105917568 | 7,608 | loss | 1659 | | N | 0 | 30 | 46.2 | high OR intergenic (OR > 30) |
| 1 | 13 | 105909960 | 105917568 | 7,608 | loss | 1717 | | N | 0 | 30 | 46.2 | high OR intergenic (OR > 30) |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 1 | 13 | 105909960 | 105917568 | 7,608 | loss | 1741 | | N | 0 | 30 | 46.2 | high OR intergenic (OR > 30) |
| 1 | 13 | 105909960 | 105917568 | 7,608 | loss | 1765 | | N | 0 | 30 | 46.2 | high OR intergenic (OR > 30) |
| 1 | 13 | 105909960 | 105917568 | 7,608 | loss | 1766 | | N | 0 | 30 | 46.2 | high OR intergenic (OR > 30) |
| 1 | 13 | 105909960 | 105917568 | 7,608 | gain | 1787 | | N | 0 | 30 | 46.2 | high OR intergenic (OR > 30) |
| 1 | 13 | 105909960 | 105917568 | 7,608 | gain | 1810 | | N | 0 | 30 | 46.2 | high OR intergenic (OR > 30) |
| 1 | 13 | 105909960 | 105917568 | 7,608 | loss | 1832 | | N | 0 | 30 | 46.2 | high OR intergenic (OR > 30) |
| 1 | 13 | 105909960 | 105917568 | 7,608 | loss | 1915 | | N | 0 | 30 | 46.2 | high OR intergenic (OR > 30) |
| 1 | 13 | 105909960 | 105917568 | 7,608 | loss | 1947 | | N | 0 | 30 | 46.2 | high OR intergenic (OR > 30) |
| 1 | 13 | 105909960 | 105917568 | 7,608 | loss | 1955 | | N | 0 | 30 | 46.2 | high OR intergenic (OR > 30) |
| 1 | 13 | 105909960 | 105917568 | 7,608 | loss | 1959 | | N | 0 | 30 | 46.2 | high OR intergenic (OR > 30) |
| 1 | 13 | 105909960 | 105917568 | 7,608 | loss | 1994 | | N | 0 | 30 | 46.2 | high OR intergenic (OR > 30) |
| 1 | 13 | 105909960 | 105917568 | 7,608 | loss | 2005 | | N | 0 | 30 | 46.2 | high OR intergenic (OR > 30) |
| 1 | 13 | 105909960 | 105917568 | 7,608 | loss | 2024 | | N | 0 | 30 | 46.2 | high OR intergenic (OR > 30) |
| 1 | 14 | 105917569 | 105926087 | 8,518 | loss | 1250 | | N | 0 | 32 | 49.43 | high OR intergenic (OR > 30) |
| 1 | 14 | 105917569 | 105926087 | 8,518 | loss | 1253 | | N | 0 | 32 | 49.43 | high OR intergenic (OR > 30) |
| 1 | 14 | 105917569 | 105926087 | 8,518 | loss | 1287 | | N | 0 | 32 | 49.43 | high OR intergenic (OR > 30) |
| 1 | 14 | 105917569 | 105926087 | 8,518 | loss | 1324 | | N | 0 | 32 | 49.43 | high OR intergenic (OR > 30) |
| 1 | 14 | 105917569 | 105926087 | 8,518 | loss | 1337 | | N | 0 | 32 | 49.43 | high OR intergenic (OR > 30) |
| 1 | 14 | 105917569 | 105926087 | 8,518 | gain | 1410 | | N | 0 | 32 | 49.43 | high OR intergenic (OR > 30) |
| 1 | 14 | 105917569 | 105926087 | 8,518 | loss | 1416 | | N | 0 | 32 | 49.43 | high OR intergenic (OR > 30) |
| 1 | 14 | 105917569 | 105926087 | 8,518 | loss | 1494 | | N | 0 | 32 | 49.43 | high OR intergenic (OR > 30) |
| 1 | 14 | 105917569 | 105926087 | 8,518 | loss | 1502 | | N | 0 | 32 | 49.43 | high OR intergenic (OR > 30) |
| 1 | 14 | 105917569 | 105926087 | 8,518 | loss | 1515 | | N | 0 | 32 | 49.43 | high OR intergenic (OR > 30) |
| 1 | 14 | 105917569 | 105926087 | 8,518 | gain | 1521 | | N | 0 | 32 | 49.43 | high OR intergenic (OR > 30) |
| 1 | 14 | 105917569 | 105926087 | 8,518 | gain | 1522 | | N | 0 | 32 | 49.43 | high OR intergenic (OR > 30) |
| 1 | 14 | 105917569 | 105926087 | 8,518 | loss | 1557 | | N | 0 | 32 | 49.43 | high OR intergenic (OR > 30) |
| 1 | 14 | 105917569 | 105926087 | 8,518 | loss | 1558 | | N | 0 | 32 | 49.43 | high OR intergenic (OR > 30) |
| 1 | 14 | 105917569 | 105926087 | 8,518 | gain | 1563 | | N | 0 | 32 | 49.43 | high OR intergenic (OR > 30) |
| 1 | 14 | 105917569 | 105926087 | 8,518 | loss | 1564 | | N | 0 | 32 | 49.43 | high OR intergenic (OR > 30) |
| 1 | 14 | 105917569 | 105926087 | 8,518 | loss | 1566 | | N | 0 | 32 | 49.43 | high OR intergenic (OR > 30) |
| 1 | 14 | 105917569 | 105926087 | 8,518 | loss | 1659 | | N | 0 | 32 | 49.43 | high OR intergenic (OR > 30) |
| 1 | 14 | 105917569 | 105926087 | 8,518 | loss | 1717 | | N | 0 | 32 | 49.43 | high OR intergenic (OR > 30) |
| 1 | 14 | 105917569 | 105926087 | 8,518 | loss | 1741 | | N | 0 | 32 | 49.43 | high OR intergenic (OR > 30) |
| 1 | 14 | 105917569 | 105926087 | 8,518 | loss | 1765 | | N | 0 | 32 | 49.43 | high OR intergenic (OR > 30) |
| 1 | 14 | 105917569 | 105926087 | 8,518 | loss | 1766 | | N | 0 | 32 | 49.43 | high OR intergenic (OR > 30) |
| 1 | 14 | 105917569 | 105926087 | 8,518 | gain | 1787 | | N | 0 | 32 | 49.43 | high OR intergenic (OR > 30) |
| 1 | 14 | 105917569 | 105926087 | 8,518 | gain | 1810 | | N | 0 | 32 | 49.43 | high OR intergenic (OR > 30) |
| 1 | 14 | 105917569 | 105926087 | 8,518 | loss | 1832 | | N | 0 | 32 | 49.43 | high OR intergenic (OR > 30) |
| 1 | 14 | 105917569 | 105926087 | 8,518 | loss | 1915 | | N | 0 | 32 | 49.43 | high OR intergenic (OR > 30) |
| 1 | 14 | 105917569 | 105926087 | 8,518 | loss | 1947 | | N | 0 | 32 | 49.43 | high OR intergenic (OR > 30) |
| 1 | 14 | 105917569 | 105926087 | 8,518 | loss | 1955 | | N | 0 | 32 | 49.43 | high OR intergenic (OR > 30) |
| 1 | 14 | 105917569 | 105926087 | 8,518 | loss | 1959 | | N | 0 | 32 | 49.43 | high OR intergenic (OR > 30) |
| 1 | 14 | 105917569 | 105926087 | 8,518 | loss | 1994 | | N | 0 | 32 | 49.43 | high OR intergenic (OR > 30) |
| 1 | 14 | 105917569 | 105926087 | 8,518 | loss | 2005 | | N | 0 | 32 | 49.43 | high OR intergenic (OR > 30) |
| 1 | 14 | 105917569 | 105926087 | 8,518 | loss | 2024 | | N | 0 | 32 | 49.43 | high OR intergenic (OR > 30) |
| 1 | 15 | 113799262 | 113801662 | 2,400 | loss | 1426 | MAGI3 | N | 0 | 7 | 10.41 | Intron+ve, ASD > 4, Normals < 2, no Sanger filter applied |
| 1 | 15 | 113799262 | 113801662 | 2,400 | loss | 1442 | MAGI3 | N | 0 | 7 | 10.41 | Intron+ve, ASD > 4, Normals < 2, no Sanger filter applied |
| 1 | 15 | 113799262 | 113801662 | 2,400 | loss | 1443 | MAGI3 | N | 0 | 7 | 10.41 | Intron+ve, ASD > 4, Normals < 2, no Sanger filter applied |
| 1 | 15 | 113799262 | 113801662 | 2,400 | loss | 1476 | MAGI3 | N | 0 | 7 | 10.41 | Intron+ve, ASD > 4, Normals < 2, no Sanger filter applied |
| 1 | 15 | 113799262 | 113801662 | 2,400 | loss | 1500 | MAGI3 | N | 0 | 7 | 10.41 | Intron+ve, ASD > 4, Normals < 2, no Sanger filter applied |
| 1 | 15 | 113799262 | 113801662 | 2,400 | loss | 1505 | MAGI3 | N | 0 | 7 | 10.41 | Intron+ve, ASD > 4, Normals < 2, no Sanger filter applied |
| 1 | 15 | 113799262 | 113801662 | 2,400 | loss | 1525 | MAGI3 | N | 0 | 7 | 10.41 | Intron+ve, ASD > 4, Normals < 2, no Sanger filter applied |
| 1 | 15 | 113801663 | 113807947 | 6,284 | loss | 1426 | MAGI3 | N | 0 | 8 | 11.92 | Intron+ve, ASD > 4, Normals < 2, no Sanger filter applied |
| 1 | 15 | 113801663 | 113807947 | 6,284 | loss | 1442 | MAGI3 | N | 0 | 8 | 11.92 | Intron+ve, ASD > 4, Normals < 2, no Sanger filter applied |
| 1 | 15 | 113801663 | 113807947 | 6,284 | loss | 1443 | MAGI3 | N | 0 | 8 | 11.92 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 1 | 15 | 113801663 | 113807947 | 6,284 | loss | 1476 | MAGI3 | N | 0 | 8 | 11.92 | Intron+ve, ASD > 4, Normals < 2, no Sanger filter applied |
| 1 | 15 | 113801663 | 113807947 | 6,284 | loss | 1500 | MAGI3 | N | 0 | 8 | 11.92 | Intron+ve, ASD > 4, Normals < 2, no Sanger filter applied |
| 1 | 15 | 113801663 | 113807947 | 6,284 | loss | 1505 | MAGI3 | N | 0 | 8 | 11.92 | Intron+ve, ASD > 4, Normals < 2, no Sanger filter applied |
| 1 | 15 | 113801663 | 113807947 | 6,284 | loss | 1525 | MAGI3 | N | 0 | 8 | 11.92 | Intron+ve, ASD > 4, Normals < 2, no Sanger filter applied |
| 1 | 15 | 113801663 | 113807947 | 6,284 | gain | 1590 | MAGI3 | N | 0 | 8 | 11.92 | Intron+ve, ASD > 4, Normals < 2, no Sanger filter applied |
| 1 | 16 | 142730209 | 143623627 | 893,418 | gain | 1599 | NBPF9, LOC653513, PPIAL4A, PDE4DIP, PPIAL4C, PPIAL4B, LOC728855, LOC728875, SRGAP2P2, C1orf152 | Y | 0 | 1 | 13.95 | Genic (distinct CNV-subregions); OR > 6 |
| 1 | 17 | 143820820 | 143822872 | 2,052 | gain | 1599 | SEC22B | Y | 1 | 2 | 2.95 | Exon+ve, 5 > ASD > 1, Normals < 2, Sanger-ve |
| 1 | 17 | 143820820 | 143822872 | 2,052 | gain | 1617 | SEC22B | Y | 1 | 2 | 2.95 | Exon+ve, 5 > ASD > 1, Normals < 2, Sanger-ve |
| 1 | 18 | 143822873 | 143830858 | 7,985 | gain | 1599 | SEC22B | Y | 1 | 3 | 4.44 | Exon+ve, 5 > ASD > 1, Normals < 2, Sanger-ve |
| 1 | 18 | 143822873 | 143830858 | 7,985 | gain | 1617 | SEC22B | Y | 1 | 3 | 4.44 | Exon+ve, 5 > ASD > 1, Normals < 2, Sanger-ve |
| 1 | 18 | 143822873 | 143830858 | 7,985 | gain | 1713 | SEC22B | Y | 1 | 3 | 4.44 | Exon+ve, 5 > ASD > 1, Normals < 2, Sanger-ve |
| 1 | 19 | 147644832 | 147847659 | 202,827 | loss | 1253 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1276 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | gain | 1293 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | gain | 1294 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1318 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | gain | 1387 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1414 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1442 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1476 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1524 | PPIAL4A, PPIAL4C, FCGR1C, LOC728855 | Y | 4 | 35 | 13.95 | Genic (distinct CNV-subregions); OR > 6 |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 1 | 19 | 147644832 | 147847659 | 202,827 | loss | 1526 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1539 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1573 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1585 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1686 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1726 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1739 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1744 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1757 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1762 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1782 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1817 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1821 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1827 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1861 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1910 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1913 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1917 | PPIAL4A, PPIAL4C, FCGR1C, LOC728855 | Y | 4 | 35 | 13.95 | Genic (distinct CNV-subregions); OR > 6 |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 1 | 19 | 147644832 | 147847659 | 202,827 | loss | 1943 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1947 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1954 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 1961 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 2002 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 2022 | PPIAL4A, PPIAL4C, FCGR1C, LOC728855 | Y | 4 | 35 | 13.95 | Genic (distinct CNV-subregions); OR > 6 |
| 1 | 19 | 147644832 | 147847659 | 202,827 | loss | 2029 | PPIAL4A, PPIAL4C, FCGR1C, LOC728855 | Y | 4 | 35 | 13.95 | Genic (distinct CNV-subregions); OR > 6 |
| 1 | 20 | 147847660 | 148081741 | 234,081 | gain | 1293 | HIST2H3A, LOC728855, HIST2H2AA4, HIST2H3D, HIST2H3C, HIST2H2BF, FCGR1A, HIST2H2AA3, HIST2H4B, HIST2H4A | Y | 0 | 11 | 16.46 | Exon+ve, ASD > 4, Normals < 2, no Sanger filter applied |
| 1 | 20 | 147847660 | 148081741 | 234,081 | gain | 1294 | HIST2H3A, LOC728855, HIST2H2AA4, HIST2H3D, HIST2H3C, HIST2H2BF, FCGR1A, HIST2H2AA3, HIST2H4B, HIST2H4A | Y | 0 | 11 | 16.46 | Exon+ve, ASD > 4, Normals < 2, no Sanger filter applied |
| 1 | 20 | 147847660 | 148081741 | 234,081 | loss | 1686 | HIST2H3A, LOC728855, HIST2H2AA4, HIST2H3D, HIST2H3C, HIST2H2BF, FCGR1A, HIST2H2AA3, HIST2H4B, HIST2H4A | Y | 0 | 11 | 16.46 | Exon+ve, ASD > 4, Normals < 2, no Sanger filter applied |
| 1 | 20 | 147847660 | 148081741 | 234,081 | loss | 1739 | HIST2H3A, LOC728855, HIST2H2AA4, HIST2H3D, HIST2H3C, HIST2H2BF, FCGR1A, HIST2H2AA3, HIST2H4B, HIST2H4A | Y | 0 | 11 | 16.46 | Exon+ve, ASD > 4, Normals < 2, no Sanger filter applied |
| 1 | 20 | 147847660 | 148081741 | 234,081 | loss | 1757 | HIST2H3A, LOC728855, HIST2H2AA4, HIST2H3D, HIST2H3C, HIST2H2BF, FCGR1A, | | | | | |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 1 | 20 | 147847660 | 148081741 | 234,081 | loss | 1817 | HIST2H2AA3, HIST2H4B, HIST2H4A, HIST2H3A, LOC728855, HIST2H2AA4, HIST2H3D, HIST2H3C, HIST2H2BF, FCGR1A, HIST2H2AA3, HIST2H4B, HIST2H4A | Y | 0 | 11 | 16.46 | Exon+ve, ASD > 4, Normals < 2, no Sanger filter applied |
| 1 | 20 | 147847660 | 148081741 | 234,081 | loss | 1861 | HIST2H3A, LOC728855, HIST2H2AA4, HIST2H3D, HIST2H3C, HIST2H2BF, FCGR1A, HIST2H2AA3, HIST2H4B, HIST2H4A | Y | 0 | 11 | 16.46 | Exon+ve, ASD > 4, d Normals < 2, no Sanger filter applied |
| 1 | 20 | 147847660 | 148081741 | 234,081 | loss | 1947 | HIST2H3A, LOC728855, HIST2H2AA4, HIST2H3D, HIST2H3C, HIST2H2BF, FCGR1A, HIST2H2AA3, HIST2H4B, HIST2H4A | Y | 0 | 11 | 16.46 | Exon+ve, ASD > 4, Normals < 2, no Sanger filter applied |
| 1 | 20 | 147847660 | 148081741 | 234,081 | loss | 1954 | HIST2H3A, LOC728855, HIST2H2AA4, HIST2H3D, HIST2H3C, HIST2H2BF, FCGR1A, HIST2H2AA3, HIST2H4B, HIST2H4A | Y | 0 | 11 | 16.46 | Exon+ve, ASD > 4, Normals < 2, no Sanger filter applied |
| 1 | 20 | 147847660 | 148081741 | 234,081 | loss | 2022 | HIST2H3A, LOC728855, HIST2H2AA4, HIST2H3D, HIST2H3C, HIST2H2BF, FCGR1A, HIST2H2AA3, HIST2H4B, HIST2H4A | Y | 0 | 11 | 16.46 | Exon+ve, ASD > 4, Normals < 2, no Sanger filter applied |
| 1 | 20 | 147847660 | 148081741 | 234,081 | loss | 2029 | HIST2H3A, LOC728855, HIST2H2AA4, HIST2H3D, HIST2H3C, HIST2H2BF, FCGR1A, HIST2H2AA3, HIST2H4B, HIST2H4A | Y | 0 | 11 | 16.46 | Exon+ve, ASD > 4, Normals < 2, no Sanger filter applied |
| 1 | 21 | 150797906 | 150818221 | 20,315 | loss | 1224 | LCE3E | Y | 1 | 5 | 7.42 | Exon+ve, ASD > 4, Normals < 2, no Sanger filter applied |
| 1 | 21 | 150797906 | 150818221 | 20,315 | loss | 1487 | LCE3E | Y | 1 | 5 | 7.42 | Exon+ve, ASD > 4, Normals < 2, no Sanger filter applied |
| 1 | 21 | 150797906 | 150818221 | 20,315 | loss | 1750 | LCE3E | Y | 1 | 5 | 7.42 | Exon+ve, ASD > 4, Normals < 2, no Sanger filter applied |
| 1 | 21 | 150797906 | 150818221 | 20,315 | loss | 1759 | LCE3E | Y | 1 | 5 | 7.42 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 1 | 21 | 150797906 | 150818221 | 20,315 | gain | 2018 | LCE3E | Y | 1 | 5 | 7.42 | Exon+ve, ASD > 4, Normals < 2, no Sanger filter applied |
| 1 | 22 | 150818222 | 150819878 | 1,656 | loss | 1224 | LCE3D | Y | 1 | 11 | 16.46 | Exon+ve, ASD > 4, Normals < 2, no Sanger filter applied |
| 1 | 22 | 150818222 | 150819878 | 1,656 | gain | 1265 | LCE3D | Y | 1 | 11 | 16.46 | Exon+ve, ASD > 4, Normals < 2, no Sanger filter applied |
| 1 | 22 | 150818222 | 150819878 | 1,656 | gain | 1267 | LCE3D | Y | 1 | 11 | 16.46 | Exon+ve, ASD > 4, Normals < 2, no Sanger filter applied |
| 1 | 22 | 150818222 | 150819878 | 1,656 | gain | 1297 | LCE3D | Y | 1 | 11 | 16.46 | Exon+ve, ASD > 4, Normals < 2, no Sanger filter applied |
| 1 | 22 | 150818222 | 150819878 | 1,656 | loss | 1487 | LCE3D | Y | 1 | 11 | 16.46 | Exon+ve, ASD > 4, Normals < 2, no Sanger filter applied |
| 1 | 22 | 150818222 | 150819878 | 1,656 | loss | 1750 | LCE3D | Y | 1 | 11 | 16.46 | Exon+ve, ASD > 4, Normals < 2, no Sanger filter applied |
| 1 | 22 | 150818222 | 150819878 | 1,656 | loss | 1759 | LCE3D | Y | 1 | 11 | 16.46 | Exon+ve, ASD > 4, Normals < 2, no Sanger filter applied |
| 1 | 22 | 150818222 | 150819878 | 1,656 | gain | 1779 | LCE3D | Y | 1 | 11 | 16.46 | Exon+ve, ASD > 4, Normals < 2, no Sanger filter applied |
| 1 | 22 | 150818222 | 150819878 | 1,656 | gain | 1953 | LCE3D | Y | 1 | 11 | 16.46 | Exon+ve, ASD > 4, Normals < 2, no Sanger filter applied |
| 1 | 22 | 150818222 | 150819878 | 1,656 | gain | 2018 | LCE3D | Y | 1 | 11 | 16.46 | Exon+ve, ASD > 4, Normals < 2, no Sanger filter applied |
| 1 | 22 | 150818222 | 150819878 | 1,656 | gain | 2034 | LCE3D | Y | 1 | 11 | 16.46 | Exon+ve, ASD > 4, Normals < 2, no Sanger filter applied |
| 1 | 23 | 181429536 | 181431556 | 2,020 | loss | 1275 | LAMC2 | N | 0 | 17 | 25.67 | Intron+ve, ASD > 4, Normals < 2, no Sanger filter applied |
| 1 | 23 | 181429536 | 181431556 | 2,020 | loss | 1277 | LAMC2 | N | 0 | 17 | 25.67 | Intron+ve, ASD > 4, Normals < 2, no Sanger filter applied |
| 1 | 23 | 181429536 | 181431556 | 2,020 | loss | 1392 | LAMC2 | N | 0 | 17 | 25.67 | Intron+ve, ASD > 4, Normals < 2, no Sanger filter applied |
| 1 | 23 | 181429536 | 181431556 | 2,020 | loss | 1410 | LAMC2 | N | 0 | 17 | 25.67 | Intron+ve, ASD > 4, Normals < 2, no Sanger filter applied |
| 1 | 23 | 181429536 | 181431556 | 2,020 | loss | 1427 | LAMC2 | N | 0 | 17 | 25.67 | Intron+ve, ASD > 4, Normals < 2, no Sanger filter applied |
| 1 | 23 | 181429536 | 181431556 | 2,020 | loss | 1696 | LAMC2 | N | 0 | 17 | 25.67 | Intron+ve, ASD > 4, Normals < 2, no Sanger filter applied |
| 1 | 23 | 181429536 | 181431556 | 2,020 | loss | 1697 | LAMC2 | N | 0 | 17 | 25.67 | Intron+ve, ASD > 4, Normals < 2, no Sanger filter applied |
| 1 | 23 | 181429536 | 181431556 | 2,020 | loss | 1774 | LAMC2 | N | 0 | 17 | 25.67 | Intron+ve, ASD > 4, Normals < 2, no Sanger filter applied |
| 1 | 23 | 181429536 | 181431556 | 2,020 | loss | 1777 | LAMC2 | N | 0 | 17 | 25.67 | Intron+ve, ASD > 4, Normals < 2, no Sanger filter applied |
| 1 | 23 | 181429536 | 181431556 | 2,020 | loss | 1778 | LAMC2 | N | 0 | 17 | 25.67 | Intron+ve, ASD > 4, Normals < 2, no Sanger filter applied |
| 1 | 23 | 181429536 | 181431556 | 2,020 | loss | 1824 | LAMC2 | N | 0 | 17 | 25.67 | Intron+ve, ASD > 4, Normals < 2, no Sanger filter applied |
| 1 | 23 | 181429536 | 181431556 | 2,020 | loss | 1838 | LAMC2 | N | 0 | 17 | 25.67 | Intron+ve, ASD > 4, Normals < 2, no Sanger filter applied |
| 1 | 23 | 181429536 | 181431556 | 2,020 | loss | 1870 | LAMC2 | N | 0 | 17 | 25.67 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 1 | 23 | 181429536 | 181431556 | 2,020 | loss | 1883 | LAMC2 | N | 0 | 17 | 25.67 | Intron+ve, ASD > 4, Normals < 2, no Sanger filter applied |
| 1 | 23 | 181429536 | 181431556 | 2,020 | loss | 1893 | LAMC2 | N | 0 | 17 | 25.67 | Intron+ve, ASD > 4, Normals < 2, no Sanger filter applied |
| 1 | 23 | 181429536 | 181431556 | 2,020 | loss | 1950 | LAMC2 | N | 0 | 17 | 25.67 | Intron+ve, ASD > 4, Normals < 2, no Sanger filter applied |
| 1 | 23 | 181429536 | 181431556 | 2,020 | loss | 1953 | LAMC2 | N | 0 | 17 | 25.67 | Intron+ve, ASD > 4, Normals < 2, no Sanger filter applied |
| 1 | 24 | 188526975 | 188537295 | 10,320 | gain | 1354 | FAM5C | N | 0 | 5 | 7.42 | Intron+ve, ASD > 4, Normals < 2, no Sanger filter applied |
| 1 | 24 | 188526975 | 188537295 | 10,320 | gain | 1596 | FAM5C | N | 0 | 5 | 7.42 | Intron+ve, ASD > 4, Normals < 2, no Sanger filter applied |
| 1 | 24 | 188526975 | 188537295 | 10,320 | gain | 1669 | FAM5C | N | 0 | 5 | 7.42 | Intron+ve, ASD > 4, Normals < 2, no Sanger filter applied |
| 1 | 24 | 188526975 | 188537295 | 10,320 | gain | 1742 | FAM5C | N | 0 | 5 | 7.42 | Intron+ve, ASD > 4, Normals < 2, no Sanger filter applied |
| 1 | 24 | 188526975 | 188537295 | 10,320 | gain | 1788 | FAM5C | N | 0 | 5 | 7.42 | Intron+ve, ASD > 4, Normals < 2, no Sanger filter applied |
| 1 | 25 | 194977713 | 194978217 | 504 | loss | 1291 | CFH | Y | 0 | 6 | 8.91 | Exon+ve, ASD > 4, Normals < 2, no Sanger filter applied |
| 1 | 25 | 194977713 | 194978217 | 504 | loss | 1440 | CFH | Y | 0 | 6 | 8.91 | Exon+ve, ASD > 4, Normals < 2, no Sanger filter applied |
| 1 | 25 | 194977713 | 194978217 | 504 | gain | 1572 | CFH | Y | 0 | 6 | 8.91 | Exon+ve, ASD > 4, Normals < 2, no Sanger filter applied |
| 1 | 25 | 194977713 | 194978217 | 504 | gain | 1591 | CFH | Y | 0 | 6 | 8.91 | Exon+ve, ASD > 4, Normals < 2, no Sanger filter applied |
| 1 | 25 | 194977713 | 194978217 | 504 | gain | 1665 | CFH | Y | 0 | 6 | 8.91 | Exon+ve, ASD > 4, Normals < 2, no Sanger filter applied |
| 1 | 25 | 194977713 | 194978217 | 504 | loss | 1712 | CFH | Y | 0 | 6 | 8.91 | Exon+ve, ASD > 4, Normals < 2, no Sanger filter applied |
| 1 | 26 | 194978218 | 195009357 | 31,139 | loss | 1291 | CFH | Y | 0 | 18 | 27.22 | Exon+ve, ASD > 4, Normals < 2, no Sanger filter applied |
| 1 | 26 | 194978218 | 195009357 | 31,139 | loss | 1315 | CFH | Y | 0 | 18 | 27.22 | Exon+ve, ASD > 4, Normals < 2, no Sanger filter applied |
| 1 | 26 | 194978218 | 195009357 | 31,139 | loss | 1412 | CFH | Y | 0 | 18 | 27.22 | Exon+ve, ASD > 4, Normals < 2, no Sanger filter applied |
| 1 | 26 | 194978218 | 195009357 | 31,139 | loss | 1425 | CFH | Y | 0 | 18 | 27.22 | Exon+ve, ASD > 4, Normals < 2, no Sanger filter applied |
| 1 | 26 | 194978218 | 195009357 | 31,139 | loss | 1440 | CFH | Y | 0 | 18 | 27.22 | Exon+ve, ASD > 4, Normals < 2, no Sanger filter applied |
| 1 | 26 | 194978218 | 195009357 | 31,139 | loss | 1442 | CFH | Y | 0 | 18 | 27.22 | Exon+ve, ASD > 4, Normals < 2, no Sanger filter applied |
| 1 | 26 | 194978218 | 195009357 | 31,139 | loss | 1443 | CFH | Y | 0 | 18 | 27.22 | Exon+ve, ASD > 4, Normals < 2, no Sanger filter applied |
| 1 | 26 | 194978218 | 195009357 | 31,139 | loss | 1493 | CFH | Y | 0 | 18 | 27.22 | Exon+ve, ASD > 4, Normals < 2, no Sanger filter applied |
| 1 | 26 | 194978218 | 195009357 | 31,139 | loss | 1494 | CFH | Y | 0 | 18 | 27.22 | Exon+ve, ASD > 4, Normals < 2, no Sanger filter applied |
| 1 | 26 | 194978218 | 195009357 | 31,139 | loss | 1503 | CFH | Y | 0 | 18 | 27.22 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 1 | 26 | 194978218 | 195009357 | 31,139 | gain | 1572 | CFH | Y | 0 | 18 | 27.22 | Exon+ve, ASD > 4, Normals < 2, no Sanger filter applied |
| 1 | 26 | 194978218 | 195009357 | 31,139 | gain | 1591 | CFH | Y | 0 | 18 | 27.22 | Exon+ve, ASD > 4, Normals < 2, no Sanger filter applied |
| 1 | 26 | 194978218 | 195009357 | 31,139 | loss | 1633 | CFH | Y | 0 | 18 | 27.22 | Exon+ve, ASD > 4, Normals < 2, no Sanger filter applied |
| 1 | 26 | 194978218 | 195009357 | 31,139 | gain | 1665 | CFH | Y | 0 | 18 | 27.22 | Exon+ve, ASD > 4, Normals < 2, no Sanger filter applied |
| 1 | 26 | 194978218 | 195009357 | 31,139 | loss | 1712 | CFH | Y | 0 | 18 | 27.22 | Exon+ve, ASD > 4, Normals < 2, no Sanger filter applied |
| 1 | 26 | 194978218 | 195009357 | 31,139 | loss | 1717 | CFH | Y | 0 | 18 | 27.22 | Exon+ve, ASD > 4, Normals < 2, no Sanger filter applied |
| 1 | 26 | 194978218 | 195009357 | 31,139 | loss | 1917 | CFH | Y | 0 | 18 | 27.22 | Exon+ve, ASD > 4, Normals < 2, no Sanger filter applied |
| 1 | 26 | 194978218 | 195009357 | 31,139 | loss | 1968 | CFH | Y | 0 | 18 | 27.22 | Exon+ve, ASD > 4, Normals < 2, no Sanger filter applied |
| 1 | 27 | 199082295 | 199149078 | 66,783 | gain | 1587 | CAMSAPIL1, C1orf106, CPR25 | Y | 1 | 2 | 2.95 | Exon+ve, 5 > ASD > 1, Normals < 2, Sanger-ve |
| 1 | 27 | 199082295 | 199149078 | 66,783 | gain | 1799 | CAMSAPIL1, C1orf106, CPR25 | Y | 1 | 2 | 2.95 | Exon+ve, 5 > ASD > 1, Normals < 2, Sanger-ve |
| 1 | 28 | 209725571 | 209741682 | 16,111 | loss | 1297 | RD3 | Y | 1 | 3 | 4.44 | Exon+ve, 5 > ASD > 1, Normals < 2, Sanger-ve |
| 1 | 28 | 209725571 | 209741682 | 16,111 | loss | 1804 | RD3 | Y | 1 | 3 | 4.44 | Exon+ve, 5 > ASD > 1, Normals < 2, Sanger-ve |
| 1 | 28 | 209725571 | 209741682 | 16,111 | loss | 1918 | RD3 | Y | 1 | 3 | 4.44 | Exon+ve, 5 > ASD > 1, Normals < 2, Sanger-ve |
| 1 | 29 | 244771086 | 244794417 | 23,331 | loss | 1767 | TFB2M | Y | 1 | 2 | 2.95 | Exon+ve, 5 > ASD > 1, Normals < 2, Sanger-ve |
| 1 | 29 | 244771086 | 244794417 | 23,331 | gain | 1819 | TFB2M | Y | 1 | 2 | 2.95 | Exon+ve, 5 > ASD > 1, Normals < 2, Sanger-ve |
| 1 | 30 | 246769019 | 246794551 | 25,532 | loss | 1664 | OR2T29 | Y | 1 | 2 | 2.95 | Exon+ve, 5 > ASD > 1, Normals < 2, Sanger-ve |
| 1 | 30 | 246769019 | 246794551 | 25,532 | loss | 1672 | OR2T29 | Y | 1 | 2 | 2.95 | Exon+ve, 5 > ASD > 1, Normals < 2, Sanger-ve |
| 1 | 31 | 247071226 | 247073548 | 2,322 | loss | 1678 | SH3BP5L | Y | 1 | 2 | 2.95 | Exon+ve, 5 > ASD > 1, Normals < 2, Sanger-ve |
| 1 | 31 | 247071226 | 247073548 | 2,322 | loss | 2022 | SH3BP5L | Y | 1 | 2 | 2.95 | Exon+ve, 5 > ASD > 1, Normals < 2, Sanger-ve |
| 2 | 32 | 20234103 | 20236210 | 2,107 | loss | 1272 | | N | 0 | 20 | 30.33 | high OR intergenic (OR > 30) |
| 2 | 32 | 20234103 | 20236210 | 2,107 | loss | 1275 | | N | 0 | 20 | 30.33 | high OR intergenic (OR > 30) |
| 2 | 32 | 20234103 | 20236210 | 2,107 | loss | 1404 | | N | 0 | 20 | 30.33 | high OR intergenic (OR > 30) |
| 2 | 32 | 20234103 | 20236210 | 2,107 | loss | 1437 | | N | 0 | 20 | 30.33 | high OR intergenic (OR > 30) |
| 2 | 32 | 20234103 | 20236210 | 2,107 | loss | 1443 | | N | 0 | 20 | 30.33 | high OR intergenic (OR > 30) |
| 2 | 32 | 20234103 | 20236210 | 2,107 | loss | 1487 | | N | 0 | 20 | 30.33 | high OR intergenic (OR > 30) |
| 2 | 32 | 20234103 | 20236210 | 2,107 | loss | 1488 | | N | 0 | 20 | 30.33 | high OR intergenic (OR > 30) |
| 2 | 32 | 20234103 | 20236210 | 2,107 | loss | 1541 | | N | 0 | 20 | 30.33 | high OR intergenic (OR > 30) |
| 2 | 32 | 20234103 | 20236210 | 2,107 | loss | 1594 | | N | 0 | 20 | 30.33 | high OR intergenic (OR > 30) |
| 2 | 32 | 20234103 | 20236210 | 2,107 | loss | 1607 | | N | 0 | 20 | 30.33 | high OR intergenic (OR > 30) |
| 2 | 32 | 20234103 | 20236210 | 2,107 | loss | 1665 | | N | 0 | 20 | 30.33 | high OR intergenic (OR > 30) |
| 2 | 32 | 20234103 | 20236210 | 2,107 | loss | 1723 | | N | 0 | 20 | 30.33 | high OR intergenic (OR > 30) |
| 2 | 32 | 20234103 | 20236210 | 2,107 | loss | 1726 | | N | 0 | 20 | 30.33 | high OR intergenic (OR > 30) |
| 2 | 32 | 20234103 | 20236210 | 2,107 | loss | 1788 | | N | 0 | 20 | 30.33 | high OR intergenic (OR > 30) |
| 2 | 32 | 20234103 | 20236210 | 2,107 | loss | 1813 | | N | 0 | 20 | 30.33 | high OR intergenic (OR > 30) |
| 2 | 32 | 20234103 | 20236210 | 2,107 | loss | 1853 | | N | 0 | 20 | 30.33 | high OR intergenic (OR > 30) |
| 2 | 32 | 20234103 | 20236210 | 2,107 | loss | 1879 | | N | 0 | 20 | 30.33 | high OR intergenic (OR > 30) |
| 2 | 32 | 20234103 | 20236210 | 2,107 | loss | 1952 | | N | 0 | 20 | 30.33 | high OR intergenic (OR > 30) |
| 2 | 32 | 20234103 | 20236210 | 2,107 | loss | 2020 | | N | 0 | 20 | 30.33 | high OR intergenic (OR > 30) |
| 2 | 32 | 20234103 | 20236210 | 2,107 | loss | 2035 | | N | 0 | 20 | 30.33 | high OR intergenic (OR > 30) |
| 2 | 33 | 35556102 | 35562007 | 5,905 | gain | 1230 | | N | 0 | 22 | 33.47 | high OR intergenic (OR > 30) |
| 2 | 33 | 35556102 | 35562007 | 5,905 | gain | 1263 | | N | 0 | 22 | 33.47 | high OR intergenic (OR > 30) |
| 2 | 33 | 35556102 | 35562007 | 5,905 | loss | 1271 | | N | 0 | 22 | 33.47 | high OR intergenic (OR > 30) |
| 2 | 33 | 35556102 | 35562007 | 5,905 | loss | 1276 | | N | 0 | 22 | 33.47 | high OR intergenic (OR > 30) |
| 2 | 33 | 35556102 | 35562007 | 5,905 | loss | 1286 | | N | 0 | 22 | 33.47 | high OR intergenic (OR > 30) |
| 2 | 33 | 35556102 | 35562007 | 5,905 | gain | 1417 | | N | 0 | 22 | 33.47 | high OR intergenic (OR > 30) |
| 2 | 33 | 35556102 | 35562007 | 5,905 | loss | 1456 | | N | 0 | 22 | 33.47 | high OR intergenic (OR > 30) |
| 2 | 33 | 35556102 | 35562007 | 5,905 | loss | 1470 | | N | 0 | 22 | 33.47 | high OR intergenic (OR > 30) |
| 2 | 33 | 35556102 | 35562007 | 5,905 | gain | 1568 | | N | 0 | 22 | 33.47 | high OR intergenic (OR > 30) |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 2 | 33 | 35556102 | 35562007 | 5,905 | gain | 1589 | | N | 0 | 22 | 33.47 | high OR intergenic (OR > 30) |
| 2 | 33 | 35556102 | 35562007 | 5,905 | gain | 1606 | | N | 0 | 22 | 33.47 | high OR intergenic (OR > 30) |
| 2 | 33 | 35556102 | 35562007 | 5,905 | gain | 1611 | | N | 0 | 22 | 33.47 | high OR intergenic (OR > 30) |
| 2 | 33 | 35556102 | 35562007 | 5,905 | gain | 1612 | | N | 0 | 22 | 33.47 | high OR intergenic (OR > 30) |
| 2 | 33 | 35556102 | 35562007 | 5,905 | gain | 1614 | | N | 0 | 22 | 33.47 | high OR intergenic (OR > 30) |
| 2 | 33 | 35556102 | 35562007 | 5,905 | gain | 1637 | | N | 0 | 22 | 33.47 | high OR intergenic (OR > 30) |
| 2 | 33 | 35556102 | 35562007 | 5,905 | gain | 1670 | | N | 0 | 22 | 33.47 | high OR intergenic (OR > 30) |
| 2 | 33 | 35556102 | 35562007 | 5,905 | loss | 1726 | | N | 0 | 22 | 33.47 | high OR intergenic (OR > 30) |
| 2 | 33 | 35556102 | 35562007 | 5,905 | gain | 1864 | | N | 0 | 22 | 33.47 | high OR intergenic (OR > 30) |
| 2 | 33 | 35556102 | 35562007 | 5,905 | gain | 1881 | | N | 0 | 22 | 33.47 | high OR intergenic (OR > 30) |
| 2 | 33 | 35556102 | 35562007 | 5,905 | gain | 1918 | | N | 0 | 22 | 33.47 | high OR intergenic (OR > 30) |
| 2 | 33 | 35556102 | 35562007 | 5,905 | gain | 1956 | | N | 0 | 22 | 33.47 | high OR intergenic (OR > 30) |
| 2 | 33 | 35556102 | 35562007 | 5,905 | gain | 1969 | | N | 0 | 22 | 33.47 | high OR intergenic (OR > 30) |
| 2 | 34 | 76849598 | 76854518 | 4,920 | loss | 1599 | LRRTM4 | N | 0 | 1 | 8.24 | Genic (distinct CNV-subregions); OR > 6 |
| 2 | 34 | 76854519 | 76863459 | 8,940 | loss | 1254 | LRRTM4 | N | 4 | 19 | 8.24 | Genic (distinct CNV-subregions); OR > 6 |
| 2 | 34 | 76854519 | 76863459 | 8,940 | loss | 1279 | LRRTM4 | N | 4 | 19 | 8.24 | Genic (distinct CNV-subregions); OR > 6 |
| 2 | 34 | 76854519 | 76863459 | 8,940 | loss | 1286 | LRRTM4 | N | 4 | 19 | 8.24 | Genic (distinct CNV-subregions); OR > 6 |
| 2 | 34 | 76854519 | 76863459 | 8,940 | loss | 1289 | LRRTM4 | N | 4 | 19 | 8.24 | Genic (distinct CNV-subregions); OR > 6 |
| 2 | 34 | 76854519 | 76863459 | 8,940 | loss | 1295 | LRRTM4 | N | 4 | 19 | 8.24 | Genic (distinct CNV-subregions); OR > 6 |
| 2 | 34 | 76854519 | 76863459 | 8,940 | loss | 1344 | LRRTM4 | N | 4 | 19 | 8.24 | Genic (distinct CNV-subregions); OR > 6 |
| 2 | 34 | 76854519 | 76863459 | 8,940 | loss | 1424 | LRRTM4 | N | 4 | 19 | 8.24 | Genic (distinct CNV-subregions); OR > 6 |
| 2 | 34 | 76854519 | 76863459 | 8,940 | loss | 1456 | LRRTM4 | N | 4 | 19 | 8.24 | Genic (distinct CNV-subregions); OR > 6 |
| 2 | 34 | 76854519 | 76863459 | 8,940 | loss | 1492 | LRRTM4 | N | 4 | 19 | 8.24 | Genic (distinct CNV-subregions); OR > 6 |
| 2 | 34 | 76854519 | 76863459 | 8,940 | loss | 1495 | LRRTM4 | N | 4 | 19 | 8.24 | Genic (distinct CNV-subregions); OR > 6 |
| 2 | 34 | 76854519 | 76863459 | 8,940 | loss | 1501 | LRRTM4 | N | 4 | 19 | 8.24 | Genic (distinct CNV-subregions); OR > 6 |
| 2 | 34 | 76854519 | 76863459 | 8,940 | loss | 1512 | LRRTM4 | N | 4 | 19 | 8.24 | Genic (distinct CNV-subregions); OR > 6 |
| 2 | 34 | 76854519 | 76863459 | 8,940 | loss | 1524 | LRRTM4 | N | 4 | 19 | 8.24 | Genic (distinct CNV-subregions); OR > 6 |
| 2 | 34 | 76854519 | 76863459 | 8,940 | loss | 1525 | LRRTM4 | N | 4 | 19 | 8.24 | Genic (distinct CNV-subregions); OR > 6 |
| 2 | 34 | 76854519 | 76863459 | 8,940 | loss | 1599 | LRRTM4 | N | 4 | 19 | 8.24 | Genic (distinct CNV-subregions); OR > 6 |
| 2 | 34 | 76854519 | 76863459 | 8,940 | gain | 1660 | LRRTM4 | N | 4 | 19 | 8.24 | Genic (distinct CNV-subregions); OR > 6 |
| 2 | 34 | 76854519 | 76863459 | 8,940 | loss | 1711 | LRRTM4 | N | 4 | 19 | 8.24 | Genic (distinct CNV-subregions); OR > 6 |
| 2 | 34 | 76854519 | 76863459 | 8,940 | loss | 1909 | LRRTM4 | N | 4 | 19 | 8.24 | Genic (distinct CNV-subregions); OR > 6 |
| 2 | 34 | 76854519 | 76863459 | 8,940 | loss | 2031 | LRRTM4 | N | 4 | 19 | 8.24 | Genic (distinct CNV-subregions); OR > 6 |
| 2 | 35 | 76863460 | 76866680 | 3,220 | loss | 1456 | LRRTM4 | N | 0 | 3 | 8.24 | Genic (distinct CNV-subregions); OR > 6 |
| 2 | 35 | 76863460 | 76866680 | 3,220 | loss | 1525 | LRRTM4 | N | 0 | 3 | 8.24 | Genic (distinct CNV-subregions); OR > 6 |
| 2 | 35 | 76863460 | 76866680 | 3,220 | loss | 1599 | LRRTM4 | N | 0 | 3 | 8.24 | Genic (distinct CNV-subregions); OR > 6 |
| 2 | 36 | 76866681 | 76868055 | 1,374 | loss | 1456 | LRRTM4 | N | 0 | 2 | 8.24 | Genic (distinct CNV-subregions); OR > 6 |
| 2 | 36 | 76866681 | 76868055 | 1,374 | loss | 1525 | LRRTM4 | N | 0 | 2 | 8.24 | Genic (distinct CNV-subregions); OR > 6 |
| 2 | 37 | 77040204 | 77041952 | 1,748 | loss | 1416 | LRRTM4 | N | 0 | 2 | 8.24 | Genic (distinct CNV-subregions); OR > 6 |
| 2 | 37 | 77040204 | 77041952 | 1,748 | loss | 1418 | LRRTM4 | N | 0 | 2 | 8.24 | Genic (distinct CNV-subregions); OR > 6 |
| 2 | 38 | 77080924 | 77083734 | 2,810 | loss | 1474 | LRRTM4 | N | 0 | 3 | 8.24 | Genic (distinct CNV-subregions); OR > 6 |
| 2 | 38 | 77080924 | 77083734 | 2,810 | loss | 1822 | LRRTM4 | N | 0 | 3 | 8.24 | Genic (distinct CNV-subregions); OR > 6 |
| 2 | 38 | 77080924 | 77083734 | 2,810 | loss | 1850 | LRRTM4 | N | 0 | 3 | 8.24 | Genic (distinct CNV-subregions); OR > 6 |
| 2 | 39 | 77083735 | 77088262 | 4,527 | loss | 1474 | LRRTM4 | N | 0 | 2 | 8.24 | Genic (distinct CNV-subregions); OR > 6 |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 2 | 39 | 77083735 | 77088262 | 4,527 | loss | 1850 | LRRTM4 | N | 0 | 2 | 8.24 | Genic (distinct CNV-subregions); OR > 6 |
| 2 | 40 | 77088263 | 77101859 | 13,596 | loss | 1850 | LRRTM4 | N | 0 | 1 | 8.24 | Genic (distinct CNV-subregions); OR > 6 |
| 2 | 41 | 77465598 | 77466768 | 1,170 | loss | 1305 | LRRTM4 | N | 1 | 3 | 8.24 | Genic (distinct CNV-subregions); OR > 6 |
| 2 | 41 | 77465598 | 77466768 | 1,170 | loss | 1347 | LRRTM4 | N | 1 | 3 | 8.24 | Genic (distinct CNV-subregions); OR > 6 |
| 2 | 41 | 77465598 | 77466768 | 1,170 | loss | 1991 | LRRTM4 | N | 1 | 3 | 8.24 | Genic (distinct CNV-OR > 6 |
| 2 | 42 | 85465078 | 85500335 | 35,257 | loss | 1624 | ELMOD3, CAPG | Y | 1 | 2 | 2.95 | Exon+ve, 5 > ASD > 1, Normals < 2, Sanger-ve |
| 2 | 42 | 85465078 | 85500335 | 35,257 | loss | 1928 | ELMOD3, CAPG | Y | 1 | 2 | 2.95 | Exon+ve, 5 > ASD > 1, Normals < 2, Sanger-ve |
| 2 | 43 | 112308559 | 112337951 | 29,392 | gain | 1498 | ANAPC1 | Y | 1 | 8 | 11.92 | Exon+ve, ASD > 4, Normals < 2, no Sanger filter applied |
| 2 | 43 | 112308559 | 112337951 | 29,392 | gain | 1558 | ANAPC1 | Y | 1 | 8 | 11.92 | Exon+ve, ASD > 4, Normals < 2, no Sanger filter applied |
| 2 | 43 | 112308559 | 112337951 | 29,392 | loss | 1794 | ANAPC1 | Y | 1 | 8 | 11.92 | Exon+ve, ASD > 4, Normals < 2, no Sanger filter applied |
| 2 | 43 | 112308559 | 112337951 | 29,392 | loss | 1810 | ANAPC1 | Y | 1 | 8 | 11.92 | Exon+ve, ASD > 4, Normals < 2, no Sanger filter applied |
| 2 | 43 | 112308559 | 112337951 | 29,392 | loss | 1814 | ANAPC1 | Y | 1 | 8 | 11.92 | Exon+ve, ASD > 4, Normals < 2, no Sanger filter applied |
| 2 | 43 | 112308559 | 112337951 | 29,392 | loss | 1833 | ANAPC1 | Y | 1 | 8 | 11.92 | Exon+ve, ASD > 4, Normals < 2, no Sanger filter applied |
| 2 | 43 | 112308559 | 112337951 | 29,392 | loss | 1908 | ANAPC1 | Y | 1 | 8 | 11.92 | Exon+ve, ASD > 4, Normals < 2, no Sanger filter applied |
| 2 | 43 | 112308559 | 112337951 | 29,392 | loss | 2005 | ANAPC1 | Y | 1 | 8 | 11.92 | Exon+ve, ASD > 4, Normals < 2, no Sanger filter applied |
| 2 | 44 | 112752278 | 112761949 | 9,671 | gain | 1266 | ZC3H6 | N | 0 | 5 | 7.42 | Intron+ve, ASD > 4, Normals < 2, no Sanger filter applied |
| 2 | 44 | 112752278 | 112761949 | 9,671 | gain | 1653 | ZC3H6 | N | 0 | 5 | 7.42 | Intron+ve, ASD > 4, Normals < 2, no Sanger filter applied |
| 2 | 44 | 112752278 | 112761949 | 9,671 | gain | 1694 | ZC3H6 | N | 0 | 5 | 7.42 | Intron+ve, ASD > 4, Normals < 2, no Sanger filter applied |
| 2 | 44 | 112752278 | 112761949 | 9,671 | loss | 1905 | ZC3H6 | N | 0 | 5 | 7.42 | Intron+ve, ASD > 4, Normals < 2, no Sanger filter applied |
| 2 | 44 | 112752278 | 112761949 | 9,671 | gain | 1910 | ZC3H6 | N | 0 | 5 | 7.42 | Intron+ve, ASD > 4, Normals < 2, no Sanger filter applied |
| 2 | 45 | 113215024 | 113216275 | 1,251 | loss | 1249 | CKAP2L | Y | 1 | 3 | 4.44 | Exon+ve, 5 > ASD > 1, Normals < 2, Sanger-ve |
| 2 | 45 | 113215024 | 113216275 | 1,251 | loss | 1265 | CKAP2L | Y | 1 | 3 | 4.44 | Exon+ve, 5 > ASD > 1, Normals < 2, Sanger-ve |
| 2 | 45 | 113215024 | 113216275 | 1,251 | loss | 1306 | CKAP2L | Y | 1 | 3 | 4.44 | Exon+ve, 5 > ASD > 1, Normals < 2, Sanger-ve |
| 2 | 46 | 115492911 | 115493163 | 252 | loss | 1293 | DPP10 | N | 0 | 19 | 28.77 | Intron+ve, ASD > 4, Normals < 2, no Sanger filter applied |
| 2 | 46 | 115492911 | 115493163 | 252 | loss | 1298 | DPP10 | N | 0 | 19 | 28.77 | Intron+ve, ASD > 4, Normals < 2, no Sanger filter applied |
| 2 | 46 | 115492911 | 115493163 | 252 | loss | 1720 | DPP10 | N | 0 | 19 | 28.77 | Intron+ve, ASD > 4, Normals < 2, no Sanger filter applied |
| 2 | 46 | 115492911 | 115493163 | 252 | loss | 1723 | DPP10 | N | 0 | 19 | 28.77 | Intron+ve, ASD > 4, Normals < 2, no Sanger filter applied |
| 2 | 46 | 115492911 | 115493163 | 252 | loss | 1798 | DPP10 | N | 0 | 19 | 28.77 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 2 | 46 | 115492911 | 115493163 | 252 | loss | 1837 | DPP10 | N | 0 | 19 | 28.77 | Intron+ve, ASD > 4, Normals < 2, no Sanger filter applied |
| 2 | 46 | 115492911 | 115493163 | 252 | loss | 1855 | DPP10 | N | 0 | 19 | 28.77 | Intron+ve, ASD > 4, Normals < 2, no Sanger filter applied |
| 2 | 46 | 115492911 | 115493163 | 252 | loss | 1916 | DPP10 | N | 0 | 19 | 28.77 | Intron+ve, ASD > 4, Normals < 2, no Sanger filter applied |
| 2 | 46 | 115492911 | 115493163 | 252 | loss | 1935 | DPP10 | N | 0 | 19 | 28.77 | Intron+ve, ASD > 4, Normals < 2, no Sanger filter applied |
| 2 | 46 | 115492911 | 115493163 | 252 | loss | 1942 | DPP10 | N | 0 | 19 | 28.77 | Intron+ve, ASD > 4, Normals < 2, no Sanger filter applied |
| 2 | 46 | 115492911 | 115493163 | 252 | loss | 1946 | DPP10 | N | 0 | 19 | 28.77 | Intron+ve, ASD > 4, Normals < 2, no Sanger filter applied |
| 2 | 46 | 115492911 | 115493163 | 252 | loss | 1952 | DPP10 | N | 0 | 19 | 28.77 | Intron+ve, ASD > 4, Normals < 2, no Sanger filter applied |
| 2 | 46 | 115492911 | 115493163 | 252 | loss | 1953 | DPP10 | N | 0 | 19 | 28.77 | Intron+ve, ASD > 4, Normals < 2, no Sanger filter applied |
| 2 | 46 | 115492911 | 115493163 | 252 | loss | 1958 | DPP10 | N | 0 | 19 | 28.77 | Intron+ve, ASD > 4, Normals < 2, no Sanger filter applied |
| 2 | 46 | 115492911 | 115493163 | 252 | loss | 1960 | DPP10 | N | 0 | 19 | 28.77 | Intron+ve, ASD > 4, Normals < 2, no Sanger filter applied |
| 2 | 46 | 115492911 | 115493163 | 252 | loss | 1963 | DPP10 | N | 0 | 19 | 28.77 | Intron+ve, ASD > 4, Normals < 2, no Sanger filter applied |
| 2 | 46 | 115492911 | 115493163 | 252 | loss | 1965 | DPP10 | N | 0 | 19 | 28.77 | Intron+ve, ASD > 4, Normals < 2, no Sanger filter applied |
| 2 | 46 | 115492911 | 115493163 | 252 | loss | 1966 | DPP10 | N | 0 | 19 | 28.77 | Intron+ve, ASD > 4, Normals < 2, no Sanger filter applied |
| 2 | 46 | 115492911 | 115493163 | 252 | loss | 1969 | DPP10 | N | 0 | 19 | 28.77 | Intron+ve, ASD > 4, Normals < 2, no Sanger filter applied |
| 2 | 47 | 120359909 | 120361151 | 1,242 | gain | 1224 | PTPN4 | Y | 1 | 2 | 2.95 | Exon+ve, 5 > ASD > 1, Normals < 2, Sanger−ve |
| 2 | 47 | 120359909 | 120361151 | 1,242 | gain | 1942 | PTPN4 | Y | 1 | 2 | 2.95 | Exon+ve, 5 > ASD > 1, Normals < 2, Sanger−ve |
| 2 | 48 | 131943629 | 131976434 | 32,805 | loss | 1224 | LOC150776, TUBA3D, MZT2A | Y | 1 | 9 | 13.43 | Exon+ve, ASD > 4, Normals < 2, no Sanger filter applied |
| 2 | 48 | 131943629 | 131976434 | 32,805 | loss | 1295 | LOC150776, TUBA3D, MZT2A | Y | 1 | 9 | 13.43 | Exon+ve, ASD > 4, Normals < 2, no Sanger filter applied |
| 2 | 48 | 131943629 | 131976434 | 32,805 | loss | 1301 | LOC150776, TUBA3D, MZT2A | Y | 1 | 9 | 13.43 | Exon+ve, ASD > 4, Normals < 2, no Sanger filter applied |
| 2 | 48 | 131943629 | 131976434 | 32,805 | loss | 1404 | LOC150776, TUBA3D, MZT2A | Y | 1 | 9 | 13.43 | Exon+ve, ASD > 4, Normals < 2, no Sanger filter applied |
| 2 | 48 | 131943629 | 131976434 | 32,805 | loss | 1492 | LOC150776, TUBA3D, MZT2A | Y | 1 | 9 | 13.43 | Exon+ve, ASD > 4, Normals < 2, no Sanger filter applied |
| 2 | 48 | 131943629 | 131976434 | 32,805 | loss | 1742 | LOC150776, TUBA3D, MZT2A | Y | 1 | 9 | 13.43 | Exon+ve, ASD > 4, Normals < 2, no Sanger filter applied |
| 2 | 48 | 131943629 | 131976434 | 32,805 | loss | 1896 | LOC150776, TUBA3D, MZT2A | Y | 1 | 9 | 13.43 | Exon+ve, ASD > 4, Normals < 2, no Sanger filter applied |
| 2 | 48 | 131943629 | 131976434 | 32,805 | loss | 1900 | LOC150776, TUBA3D, MZT2A | Y | 1 | 9 | 13.43 | Exon+ve, ASD > 4, Normals < 2, no Sanger filter applied |
| 2 | 48 | 131943629 | 131976434 | 32,805 | loss | 1917 | LOC150776, TUBA3D, MZT2A | Y | 1 | 9 | 13.43 | Exon+ve, ASD > 4, Normals < 2, no Sanger filter applied |
| 2 | 49 | 140701510 | 140702990 | 1,480 | gain | 1237 |  | N | 0 | 22 | 33.47 | high OR intergenic (OR > 30) |
| 2 | 49 | 140701510 | 140702990 | 1,480 | gain | 1240 |  | N | 0 | 22 | 33.47 | high OR intergenic (OR > 30) |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 2 | 49 | 140701510 | 140702990 | 1,480 | gain | 1272 | | N | 0 | 22 | 33.47 | high OR intergenic (OR > 30) |
| 2 | 49 | 140701510 | 140702990 | 1,480 | gain | 1343 | | N | 0 | 22 | 33.47 | high OR intergenic (OR > 30) |
| 2 | 49 | 140701510 | 140702990 | 1,480 | gain | 1432 | | N | 0 | 22 | 33.47 | high OR intergenic (OR > 30) |
| 2 | 49 | 140701510 | 140702990 | 1,480 | gain | 1501 | | N | 0 | 22 | 33.47 | high OR intergenic (OR > 30) |
| 2 | 49 | 140701510 | 140702990 | 1,480 | gain | 1601 | | N | 0 | 22 | 33.47 | high OR intergenic (OR > 30) |
| 2 | 49 | 140701510 | 140702990 | 1,480 | gain | 1616 | | N | 0 | 22 | 33.47 | high OR intergenic (OR > 30) |
| 2 | 49 | 140701510 | 140702990 | 1,480 | gain | 1617 | | N | 0 | 22 | 33.47 | high OR intergenic (OR > 30) |
| 2 | 49 | 140701510 | 140702990 | 1,480 | gain | 1618 | | N | 0 | 22 | 33.47 | high OR intergenic (OR > 30) |
| 2 | 49 | 140701510 | 140702990 | 1,480 | gain | 1620 | | N | 0 | 22 | 33.47 | high OR intergenic (OR > 30) |
| 2 | 49 | 140701510 | 140702990 | 1,480 | gain | 1629 | | N | 0 | 22 | 33.47 | high OR intergenic (OR > 30) |
| 2 | 49 | 140701510 | 140702990 | 1,480 | gain | 1642 | | N | 0 | 22 | 33.47 | high OR intergenic (OR > 30) |
| 2 | 49 | 140701510 | 140702990 | 1,480 | gain | 1645 | | N | 0 | 22 | 33.47 | high OR intergenic (OR > 30) |
| 2 | 49 | 140701510 | 140702990 | 1,480 | gain | 1672 | | N | 0 | 22 | 33.47 | high OR intergenic (OR > 30) |
| 2 | 49 | 140701510 | 140702990 | 1,480 | gain | 1865 | | N | 0 | 22 | 33.47 | high OR intergenic (OR > 30) |
| 2 | 49 | 140701510 | 140702990 | 1,480 | gain | 1900 | | N | 0 | 22 | 33.47 | high OR intergenic (OR > 30) |
| 2 | 49 | 140701510 | 140702990 | 1,480 | gain | 1904 | | N | 0 | 22 | 33.47 | high OR intergenic (OR > 30) |
| 2 | 49 | 140701510 | 140702990 | 1,480 | gain | 1949 | | N | 0 | 22 | 33.47 | high OR intergenic (OR > 30) |
| 2 | 49 | 140701510 | 140702990 | 1,480 | gain | 1999 | | N | 0 | 22 | 33.47 | high OR intergenic (OR > 30) |
| 2 | 49 | 140701510 | 140702990 | 1,480 | gain | 2031 | | N | 0 | 22 | 33.47 | high OR intergenic (OR > 30) |
| 2 | 49 | 140701510 | 140702990 | 1,480 | gain | 2034 | | N | 0 | 22 | 33.47 | high OR intergenic (OR > 30) |
| 2 | 50 | 150020372 | 150022009 | 1,637 | gain | 1281 | LYPD6 | N | 0 | 8 | 11.92 | Intron+ve, ASD > 4, Normals < 2, no Sanger filter applied |
| 2 | 50 | 150020372 | 150022009 | 1,637 | gain | 1389 | LYPD6 | N | 0 | 8 | 11.92 | Intron+ve, ASD > 4, Normals < 2, no Sanger filter applied |
| 2 | 50 | 150020372 | 150022009 | 1,637 | gain | 1391 | LYPD6 | N | 0 | 8 | 11.92 | Intron+ve, ASD > 4, Normals < 2, no Sanger filter applied |
| 2 | 50 | 150020372 | 150022009 | 1,637 | gain | 1411 | LYPD6 | N | 0 | 8 | 11.92 | Intron+ve, ASD > 4, Normals < 2, no Sanger filter applied |
| 2 | 50 | 150020372 | 150022009 | 1,637 | gain | 1434 | LYPD6 | N | 0 | 8 | 11.92 | Intron+ve, ASD > 4, Normals < 2, no Sanger filter applied |
| 2 | 50 | 150020372 | 150022009 | 1,637 | gain | 1435 | LYPD6 | N | 0 | 8 | 11.92 | Intron+ve, ASD > 4, Normals < 2, no Sanger filter applied |
| 2 | 50 | 150020372 | 150022009 | 1,637 | gain | 1449 | LYPD6 | N | 0 | 8 | 11.92 | Intron+ve, ASD > 4, Normals < 2, no Sanger filter applied |
| 2 | 50 | 150020372 | 150022009 | 1,637 | gain | 1654 | LYPD6 | N | 0 | 8 | 11.92 | Intron+ve, ASD > 4, Normals < 2, no Sanger filter applied |
| 2 | 51 | 165652444 | 165654598 | 2,154 | loss | 1484 | SCN3A | Y | 1 | 2 | 2.95 | Exon+ve, 5 > ASD > 1, Normals < 2, Sanger-ve |
| 2 | 51 | 165652444 | 165654598 | 2,154 | loss | 1873 | SCN3A | Y | 1 | 2 | 2.95 | Exon+ve, 5 > ASD > 1, Normals < 2, Sanger-ve |
| 2 | 52 | 178555243 | 178556781 | 1,538 | loss | 1410 | PDE11A | N | 1 | 5 | 7.42 | Intron+ve, ASD > 4, Normals < 2, no Sanger filter applied |
| 2 | 52 | 178555243 | 178556781 | 1,538 | loss | 1500 | PDE11A | N | 1 | 5 | 7.42 | Intron+ve, ASD > 4, Normals < 2, no Sanger filter applied |
| 2 | 52 | 178555243 | 178556781 | 1,538 | loss | 1505 | PDE11A | N | 1 | 5 | 7.42 | Intron+ve, ASD > 4, Normals < 2, no Sanger filter applied |
| 2 | 52 | 178555243 | 178556781 | 1,538 | loss | | PDE11A | N | 1 | 5 | 7.42 | Intron+ve, ASD > 4, Normals < 2, no Sanger filter applied |
| 2 | 52 | 178555243 | 178556781 | 1,538 | loss | 1949 | PDE11A | N | 1 | 5 | 7.42 | Intron+ve, ASD > 4, Normals < 2, no Sanger filter applied |
| 2 | 53 | 197607589 | 197612724 | 5,135 | loss | 1281 | ANKRD44 | N | 0 | 1 | 14.83 | Genic (distinct CNV-subregions); OR > 6 |
| 2 | 54 | 197883024 | 197884226 | 1,202 | loss | 1299 | ANKRD44 | Y | 3 | 28 | 14.83 | Genic (distinct CNV-subregions); OR > 6 |
| 2 | 54 | 197883024 | 197884226 | 1,202 | loss | 1391 | ANKRD44 | Y | 3 | 28 | 14.83 | Genic (distinct CNV-subregions); OR > 6 |
| 2 | 54 | 197883024 | 197884226 | 1,202 | gain | 1448 | ANKRD44 | Y | 3 | 28 | 14.83 | Genic (distinct CNV-subregions); OR > 6 |
| 2 | 54 | 197883024 | 197884226 | 1,202 | loss | 1465 | ANKRD44 | Y | 3 | 28 | 14.83 | Genic (distinct CNV-subregions); OR > 6 |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 2 | 54 | 197883024 | 197884226 | 1,202 | loss | 1477 | ANKRD44 | Y | 3 | 28 | 14.83 | Genic (distinct CNV-subregions); OR > 6 |
| 2 | 54 | 197883024 | 197884226 | 1,202 | loss | 1548 | ANKRD44 | Y | 3 | 28 | 14.83 | Genic (distinct CNV-subregions); OR > 6 |
| 2 | 54 | 197883024 | 197884226 | 1,202 | loss | 1559 | ANKRD44 | Y | 3 | 28 | 14.83 | Genic (distinct CNV-subregions); OR > 6 |
| 2 | 54 | 197883024 | 197884226 | 1,202 | loss | 1566 | ANKRD44 | Y | 3 | 28 | 14.83 | Genic (distinct CNV-subregions); OR > 6 |
| 2 | 54 | 197883024 | 197884226 | 1,202 | loss | 1580 | ANKRD44 | Y | 3 | 28 | 14.83 | Genic (distinct CNV-subregions); OR > 6 |
| 2 | 54 | 197883024 | 197884226 | 1,202 | gain | 1597 | ANKRD44 | Y | 3 | 28 | 14.83 | Genic (distinct CNV-subregions); OR > 6 |
| 2 | 54 | 197883024 | 197884226 | 1,202 | loss | 1609 | ANKRD44 | Y | 3 | 28 | 14.83 | Genic (distinct CNV-subregions); OR > 6 |
| 2 | 54 | 197883024 | 197884226 | 1,202 | loss | 1629 | ANKRD44 | Y | 3 | 28 | 14.83 | Genic (distinct CNV-subregions); OR > 6 |
| 2 | 54 | 197883024 | 197884226 | 1,202 | gain | 1644 | ANKRD44 | Y | 3 | 28 | 14.83 | Genic (distinct CNV-subregions); OR > 6 |
| 2 | 54 | 197883024 | 197884226 | 1,202 | loss | 1699 | ANKRD44 | Y | 3 | 28 | 14.83 | Genic (distinct CNV-subregions); OR > 6 |
| 2 | 54 | 197883024 | 197884226 | 1,202 | loss | 1704 | ANKRD44 | Y | 3 | 28 | 14.83 | Genic (distinct CNV-subregions); OR > 6 |
| 2 | 54 | 197883024 | 197884226 | 1,202 | loss | 1724 | ANKRD44 | Y | 3 | 28 | 14.83 | Genic (distinct CNV-subregions); OR > 6 |
| 2 | 54 | 197883024 | 197884226 | 1,202 | gain | 1743 | ANKRD44 | Y | 3 | 28 | 14.83 | Genic (distinct CNV-subregions); OR > 6 |
| 2 | 54 | 197883024 | 197884226 | 1,202 | loss | 1830 | ANKRD44 | Y | 3 | 28 | 14.83 | Genic (distinct CNV-subregions); OR > 6 |
| 2 | 54 | 197883024 | 197884226 | 1,202 | loss | 1844 | ANKRD44 | Y | 3 | 28 | 14.83 | Genic (distinct CNV-subregions); OR > 6 |
| 2 | 54 | 197883024 | 197884226 | 1,202 | loss | 1869 | ANKRD44 | Y | 3 | 28 | 14.83 | Genic (distinct CNV-subregions); OR > 6 |
| 2 | 54 | 197883024 | 197884226 | 1,202 | loss | 1905 | ANKRD44 | Y | 3 | 28 | 14.83 | Genic (distinct CNV-subregions); OR > 6 |
| 2 | 54 | 197883024 | 197884226 | 1,202 | loss | 1921 | ANKRD44 | Y | 3 | 28 | 14.83 | Genic (distinct CNV-subregions); OR > 6 |
| 2 | 54 | 197883024 | 197884226 | 1,202 | loss | 1952 | ANKRD44 | Y | 3 | 28 | 14.83 | Genic (distinct CNV-subregions); OR > 6 |
| 2 | 54 | 197883024 | 197884226 | 1,202 | loss | 1959 | ANKRD44 | Y | 3 | 28 | 14.83 | Genic (distinct CNV-subregions); OR > 6 |
| 2 | 54 | 197883024 | 197884226 | 1,202 | loss | 1962 | ANKRD44 | Y | 3 | 28 | 14.83 | Genic (distinct CNV-subregions); OR > 6 |
| 2 | 54 | 197883024 | 197884226 | 1,202 | loss | 1964 | ANKRD44 | Y | 3 | 28 | 14.83 | Genic (distinct CNV-subregions); OR > 6 |
| 2 | 54 | 197883024 | 197884226 | 1,202 | loss | 2031 | ANKRD44 | Y | 3 | 28 | 14.83 | Genic (distinct CNV-subregions); OR > 6 |
| 2 | 54 | 197883024 | 197884226 | 1,202 | loss | 2035 | ANKRD44 | Y | 3 | 28 | 14.83 | Genic (distinct CNV-subregions); OR > 6 |
| 2 | 55 | 213932902 | 213933569 | 667 | loss | 1386 | SPAG16 | N | 0 | 5 | 7.42 | Intron+ve, ASD > 4, Normals < 2, no Sanger filter applied |
| 2 | 55 | 213932902 | 213933569 | 667 | loss | 1500 | SPAG16 | N | 0 | 5 | 7.42 | Intron+ve, ASD > 4, Normals < 2, no Sanger filter applied |
| 2 | 55 | 213932902 | 213933569 | 667 | loss | 1583 | SPAG16 | N | 0 | 5 | 7.42 | Intron+ve, ASD > 4, Normals < 2, no Sanger filter applied |
| 2 | 55 | 213932902 | 213933569 | 667 | loss | 1870 | SPAG16 | N | 0 | 5 | 7.42 | Intron+ve, ASD > 4, Normals < 2, no Sanger filter applied |
| 2 | 55 | 213932902 | 213933569 | 667 | loss | 1912 | SPAG16 | N | 0 | 5 | 7.42 | Intron+ve, ASD > 4, Normals < 2, no Sanger filter applied |
| 2 | 56 | 215367912 | 215377668 | 9,756 | gain | 1370 | BARD1 | Y | 1 | 3 | 4.44 | Exon+ve, 5 > ASD > 1, Normals < 2, Sanger-ve |
| 2 | 56 | 215367912 | 215377668 | 9,756 | gain | 1604 | BARD1 | Y | 1 | 3 | 4.44 | Exon+ve, 5 > ASD > 1, Normals < 2, Sanger-ve |
| 2 | 56 | 215367912 | 215377668 | 9,756 | gain | 1925 | BARD1 | Y | 1 | 3 | 4.44 | Exon+ve, 5 > ASD > 1, Normals < 2, Sanger-ve |
| 3 | 57 | 310349 | 353620 | 43,271 | gain | 1273 | CHL1 | Y | 1 | 3 | 4.44 | Exon+ve, 5 > ASD > 1, Normals < 2, Sanger-ve |
| 3 | 57 | 310349 | 353620 | 43,271 | gain | 1598 | CHL1 | Y | 1 | 3 | 4.44 | Exon+ve, 5 > ASD > 1, Normals < 2, Sanger-ve |
| 3 | 57 | 310349 | 353620 | 43,271 | gain | 1657 | CHL1 | Y | 1 | 3 | 4.44 | Exon+ve, 5 > ASD > 1, Normals < 2, Sanger-ve |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 3 | 58 | 353621 | 404590 | 50,969 | gain | 1598 | CHL1 | Y | 1 | 2 | 2.95 | Exon+ve, 5 > ASD > 1, Normals < 2, Sanger–ve |
| 3 | 58 | 353621 | 404590 | 50,969 | gain | 1657 | CHL1 | Y | 1 | 2 | 2.95 | Exon+ve, 5 > ASD > 1, Normals < 2, Sanger–ve |
| 3 | 59 | 2747805 | 2795529 | 47,724 | gain | 1295 | CNTN4 | Y | 1 | 2 | 2.95 | Exon+ve, 5 > ASD > 1, Normals < 2, Sanger–ve |
| 3 | 59 | 2747805 | 2795529 | 47,724 | gain | 1851 | CNTN4 | Y | 1 | 2 | 2.95 | Exon+ve, 5 > ASD > 1, Normals < 2, Sanger–ve |
| 3 | 60 | 15587405 | 15593664 | 6,259 | loss | 1564 | HACL1 | Y | 1 | 2 | 2.95 | Exon+ve, 5 > ASD > 1, Normals < 2, Sanger–ve |
| 3 | 60 | 15587405 | 15593664 | 6,259 | loss | 1850 | HACL1 | Y | 1 | 2 | 2.95 | Exon+ve, 5 > ASD > 1, Normals < 2, Sanger–ve |
| 3 | 61 | 29373456 | 29379163 | 5,707 | loss | 1324 | RBMS3 | N | 1 | 7 | 10.41 | Intron+ve, ASD > 4, Normals < 2, no Sanger filter applied |
| 3 | 61 | 29373456 | 29379163 | 5,707 | loss | 1442 | RBMS3 | N | 1 | 7 | 10.41 | Intron+ve, ASD > 4, Normals < 2, no Sanger filter applied |
| 3 | 61 | 29373456 | 29379163 | 5,707 | loss | 1475 | RBMS3 | N | 1 | 7 | 10.41 | Intron+ve, ASD > 4, Normals < 2, no Sanger filter applied |
| 3 | 61 | 29373456 | 29379163 | 5,707 | loss | 1500 | RBMS3 | N | 1 | 7 | 10.41 | Intron+ve, ASD > 4, Normals < 2, no Sanger filter applied |
| 3 | 61 | 29373456 | 29379163 | 5,707 | loss | 1567 | RBMS3 | N | 1 | 7 | 10.41 | Intron+ve, ASD > 4, Normals < 2, no Sanger filter applied |
| 3 | 61 | 29373456 | 29379163 | 5,707 | loss | 1568 | RBMS3 | N | 1 | 7 | 10.41 | Intron+ve, ASD > 4, Normals < 2, no Sanger filter applied |
| 3 | 61 | 29373456 | 29379163 | 5,707 | loss | 1585 | RBMS3 | N | 1 | 7 | 10.41 | Intron+ve, ASD > 4, Normals < 2, no Sanger filter applied |
| 3 | 62 | 29379165 | 29380899 | 1,734 | loss | 1425 | RBMS3 | N | 0 | 5 | 7.42 | Intron+ve, ASD > 4, Normals < 2, no Sanger filter applied |
| 3 | 62 | 29379165 | 29380899 | 1,734 | loss | 1442 | RBMS3 | N | 0 | 5 | 7.42 | Intron+ve, ASD > 4, Normals < 2, no Sanger filter applied |
| 3 | 62 | 29379165 | 29380899 | 1,734 | loss | 1475 | RBMS3 | N | 0 | 5 | 7.42 | Intron+ve, ASD > 4, Normals < 2, no Sanger filter applied |
| 3 | 62 | 29379165 | 29380899 | 1,734 | loss | 1500 | RBMS3 | N | 0 | 5 | 7.42 | Intron+ve, ASD > 4, Normals < 2, no Sanger filter applied |
| 3 | 62 | 29379165 | 29380899 | 1,734 | loss | 1567 | RBMS3 | N | 0 | 5 | 7.42 | Intron+ve, ASD > 4, Normals < 2, no Sanger filter applied |
| 3 | 63 | 32285101 | 32285133 | 32 | gain | 1233 | CMTM8 | N | 1 | 8 | 11.92 | Intron+ve, ASD > 4, Normals < 2, no Sanger filter applied |
| 3 | 63 | 32285101 | 32285133 | 32 | gain | 1282 | CMTM8 | N | 1 | 8 | 11.92 | Intron+ve, ASD > 4, Normals < 2, no Sanger filter applied |
| 3 | 63 | 32285101 | 32285133 | 32 | gain | 1419 | CMTM8 | N | 1 | 8 | 11.92 | Intron+ve, ASD > 4, Normals < 2, no Sanger filter applied |
| 3 | 63 | 32285101 | 32285133 | 32 | gain | 1452 | CMTM8 | N | 1 | 8 | 11.92 | Intron+ve, ASD > 4, Normals < 2, no Sanger filter applied |
| 3 | 63 | 32285101 | 32285133 | 32 | gain | 1467 | CMTM8 | N | 1 | 8 | 11.92 | Intron+ve, ASD > 4, Normals < 2, no Sanger filter applied |
| 3 | 63 | 32285101 | 32285133 | 32 | gain | 1561 | CMTM8 | N | 1 | 8 | 11.92 | Intron+ve, ASD > 4, Normals < 2, no Sanger filter applied |
| 3 | 63 | 32285101 | 32285133 | 32 | gain | 1604 | CMTM8 | N | 1 | 8 | 11.92 | Intron+ve, ASD > 4, Normals < 2, no Sanger filter applied |
| 3 | 63 | 32285101 | 32285133 | 32 | gain | 2024 | CMTM8 | N | 1 | 8 | 11.92 | Intron+ve, ASD > 4, Normals < 2, no Sanger filter applied |
| 3 | 64 | 33871823 | 33873484 | 1,661 | loss | 1259 | PDCD6IP | N | 0 | 5 | 7.42 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 3 | 64 | 33871823 | 33873484 | 1,661 | loss | 1274 | PDCD6IP | N | 0 | 5 | 7.42 | Intron+ve, ASD > 4, Normals < 2, no Sanger filter applied |
| 3 | 64 | 33871823 | 33873484 | 1,661 | gain | 1602 | PDCD6IP | N | 0 | 5 | 7.42 | Intron+ve, ASD > 4, Normals < 2, no Sanger filter applied |
| 3 | 64 | 33871823 | 33873484 | 1,661 | loss | 1724 | PDCD6IP | N | 0 | 5 | 7.42 | Intron+ve, ASD > 4, Normals < 2, no Sanger filter applied |
| 3 | 64 | 33871823 | 33873484 | 1,661 | gain | 1926 | PDCD6IP | N | 0 | 5 | 7.42 | Intron+ve, ASD > 4, Normals < 2, no Sanger filter applied |
| 3 | 65 | 38417568 | 38428089 | 10,521 | loss | 1428 | XYLB | N | 0 | 5 | 7.42 | Intron+ve, ASD > 4, Normals < 2, no Sanger filter applied |
| 3 | 65 | 38417568 | 38428089 | 10,521 | loss | 1725 | XYLB | N | 0 | 5 | 7.42 | Intron+ve, ASD > 4, Normals < 2, no Sanger filter applied |
| 3 | 65 | 38417568 | 38428089 | 10,521 | loss | 1802 | XYLB | N | 0 | 5 | 7.42 | Intron+ve, ASD > 4, Normals < 2, no Sanger filter applied |
| 3 | 65 | 38417568 | 38428089 | 10,521 | loss | 1848 | XYLB | N | 0 | 5 | 7.42 | Intron+ve, ASD > 4, Normals < 2, no Sanger filter applied |
| 3 | 65 | 38417568 | 38428089 | 10,521 | loss | 1881 | XYLB | N | 0 | 5 | 7.42 | Intron+ve, ASD > 4, Normals < 2, no Sanger filter applied |
| 3 | 66 | 38428091 | 38430518 | 2,427 | loss | 1725 | XYLB | Y | 1 | 2 | 2.95 | Exon+ve, 5 > ASD > 1, Normals < 2, Sanger-ve |
| 3 | 66 | 38428091 | 38430518 | 2,427 | loss | 1881 | XYLB | Y | 1 | 2 | 2.95 | Exon+ve, 5 > ASD > 1, Normals < 2, Sanger-ve |
| 3 | 67 | 42713487 | 42715137 | 1,650 | loss | 1393 | HHATL | Y | 1 | 5 | 7.42 | Exon+ve, ASD > 4, Normals < 2, no Sanger filter applied |
| 3 | 67 | 42713487 | 42715137 | 1,650 | loss | 1620 | HHATL | Y | 1 | 5 | 7.42 | Exon+ve, ASD > 4, Normals < 2, no Sanger filter applied |
| 3 | 67 | 42713487 | 42715137 | 1,650 | loss | 1776 | HHATL | Y | 1 | 5 | 7.42 | Exon+ve, ASD > 4, Normals < 2, no Sanger filter applied |
| 3 | 67 | 42713487 | 42715137 | 1,650 | loss | 1806 | HHATL | Y | 1 | 5 | 7.42 | Exon+ve, ASD > 4, Normals < 2, no Sanger filter applied |
| 3 | 67 | 42713487 | 42715137 | 1,650 | loss | 1966 | HHATL | Y | 1 | 5 | 7.42 | Exon+ve, ASD > 4, Normals < 2, no Sanger filter applied |
| 3 | 68 | 42715138 | 42718285 | 3,147 | loss | 1776 | HHATL | Y | 1 | 3 | 4.44 | Exon+ve, 5 > ASD > 1, Normals < 2, Sanger-ve |
| 3 | 68 | 42715138 | 42718285 | 3,147 | loss | 1806 | HHATL | Y | 1 | 3 | 4.44 | Exon+ve, 5 > ASD > 1, Normals < 2, Sanger-ve |
| 3 | 68 | 42715138 | 42718285 | 3,147 | loss | 1966 | HHATL | Y | 1 | 3 | 4.44 | Exon+ve, 5 > ASD > 1, Normals < 2, Sanger-ve |
| 3 | 69 | 45239359 | 45244718 | 5,359 | gain | 1514 | TMEM158 | Y | 1 | 2 | 2.95 | Exon+ve, 5 > ASD > 1, Normals < 2, Sanger-ve |
| 3 | 69 | 45239359 | 45244718 | 5,359 | gain | 1874 | TMEM158 | Y | 1 | 2 | 2.95 | Exon+ve, 5 > ASD > 1, Normals < 2, Sanger-ve |
| 3 | 70 | 50166741 | 50171929 | 5,188 | loss | 1965 | SEMA3F | Y | 2 | 1 | 7.46 | Genic (distinct CNV-subregions); OR > 6 |
| 3 | 71 | 50171930 | 50173644 | 1,714 | loss | 1548 | SEMA3F | Y | 2 | 4 | 7.46 | Genic (distinct CNV-subregions); OR > 6 |
| 3 | 71 | 50171930 | 50173644 | 1,714 | loss | 1727 | SEMA3F | Y | 2 | 4 | 7.46 | Genic (distinct CNV-subregions); OR > 6 |
| 3 | 71 | 50171930 | 50173644 | 1,714 | loss | 1739 | SEMA3F | Y | 2 | 4 | 7.46 | Genic (distinct CNV-subregions); OR > 6 |
| 3 | 71 | 50171930 | 50173644 | 1,714 | loss | 1965 | SEMA3F | Y | 2 | 4 | 7.46 | Genic (distinct CNV-subregions); OR > 6 |
| 3 | 72 | 50173646 | 50174341 | 695 | loss | 1232 | SEMA3F | N | 2 | 8 | 7.46 | Genic (distinct CNV-subregions); OR > 6 |
| 3 | 72 | 50173646 | 50174341 | 695 | loss | 1299 | SEMA3F | N | 2 | 8 | 7.46 | Genic (distinct CNV-subregions); OR > 6 |
| 3 | 72 | 50173646 | 50174341 | 695 | loss | 1697 | SEMA3F | N | 2 | 8 | 7.46 | Genic (distinct CNV-subregions); OR > 6 |
| 3 | 72 | 50173646 | 50174341 | 695 | loss | 1737 | SEMA3F | N | 2 | 8 | 7.46 | Genic (distinct CNV-subregions); OR > 6 |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 3 | 72 | 50173646 | 50174341 | 695 | loss | 1739 | SEMA3F | N | 2 | 8 | 7.46 | Genic (distinct CNV-subregions); OR > 6 |
| 3 | 72 | 50173646 | 50174341 | 695 | loss | 1868 | SEMA3F | N | 2 | 8 | 7.46 | Genic (distinct CNV-subregions); OR > 6 |
| 3 | 72 | 50173646 | 50174341 | 695 | loss | 1958 | SEMA3F | N | 2 | 8 | 7.46 | Genic (distinct CNV-subregions); OR > 6 |
| 3 | 72 | 50173646 | 50174341 | 695 | loss | 1965 | SEMA3F | N | 2 | 8 | 7.46 | Genic (distinct CNV-subregions); OR > 6 |
| 3 | 73 | 50174342 | 50184719 | 10,377 | loss | 1965 | SEMA3F | N | 2 | 1 | 7.46 | Genic (distinct CNV-subregions); OR > 6 |
| 3 | 74 | 52999601 | 53001677 | 2,076 | loss | 1343 | SFMBT1 | N | 0 | 5 | 7.42 | Intron+ve, ASD > 4, Normals < 2, no Sanger filter applied |
| 3 | 74 | 52999601 | 53001677 | 2,076 | loss | 1515 | SFMBT1 | N | 0 | 5 | 7.42 | Intron+ve, ASD > 4, Normals < 2, no Sanger filter applied |
| 3 | 74 | 52999601 | 53001677 | 2,076 | loss | 1568 | SFMBT1 | N | 0 | 5 | 7.42 | Intron+ve, ASD > 4, Normals < 2, no Sanger filter applied |
| 3 | 74 | 52999601 | 53001677 | 2,076 | loss | 1576 | SFMBT1 | N | 0 | 5 | 7.42 | Intron+ve, ASD > 4, Normals < 2, no Sanger filter applied |
| 3 | 74 | 52999601 | 53001677 | 2,076 | loss | 1587 | SFMBT1 | N | 0 | 5 | 7.42 | Intron+ve, ASD > 4, Normals < 2, no Sanger filter applied |
| 3 | 75 | 53001678 | 53003135 | 1,457 | loss | 1236 | SFMBT1 | N | 0 | 13 | 19.51 | Intron+ve, ASD > 4, Normals < 2, no Sanger filter applied |
| 3 | 75 | 53001678 | 53003135 | 1,457 | loss | 1272 | SFMBT1 | N | 0 | 13 | 19.51 | Intron+ve, ASD > 4, Normals < 2, no Sanger filter applied |
| 3 | 75 | 53001678 | 53003135 | 1,457 | loss | 1277 | SFMBT1 | N | 0 | 13 | 19.51 | Intron+ve, ASD > 4, Normals < 2, no Sanger filter applied |
| 3 | 75 | 53001678 | 53003135 | 1,457 | loss | 1343 | SFMBT1 | N | 0 | 13 | 19.51 | Intron+ve, ASD > 4, Normals < 2, no Sanger filter applied |
| 3 | 75 | 53001678 | 53003135 | 1,457 | loss | 1494 | SFMBT1 | N | 0 | 13 | 19.51 | Intron+ve, ASD > 4, Normals < 2, no Sanger filter applied |
| 3 | 75 | 53001678 | 53003135 | 1,457 | loss | 1515 | SFMBT1 | N | 0 | 13 | 19.51 | Intron+ve, ASD > 4, Normals < 2, no Sanger filter applied |
| 3 | 75 | 53001678 | 53003135 | 1,457 | loss | 1568 | SFMBT1 | N | 0 | 13 | 19.51 | Intron+ve, ASD > 4, Normals < 2, no Sanger filter applied |
| 3 | 75 | 53001678 | 53003135 | 1,457 | loss | 1576 | SFMBT1 | N | 0 | 13 | 19.51 | Intron+ve, ASD > 4, Normals < 2, no Sanger filter applied |
| 3 | 75 | 53001678 | 53003135 | 1,457 | loss | 1587 | SFMBT1 | N | 0 | 13 | 19.51 | Intron+ve, ASD > 4, Normals < 2, no Sanger filter applied |
| 3 | 75 | 53001678 | 53003135 | 1,457 | loss | 1605 | SFMBT1 | N | 0 | 13 | 19.51 | Intron+ve, ASD > 4, Normals < 2, no Sanger filter applied |
| 3 | 75 | 53001678 | 53003135 | 1,457 | loss | 1705 | SFMBT1 | N | 0 | 13 | 19.51 | Intron+ve, ASD > 4, Normals < 2, no Sanger filter applied |
| 3 | 75 | 53001678 | 53003135 | 1,457 | loss | 1744 | SFMBT1 | N | 0 | 13 | 19.51 | Intron+ve, ASD > 4, Normals < 2, no Sanger filter applied |
| 3 | 75 | 53001678 | 53003135 | 1,457 | loss | 1792 | SFMBT1 | N | 0 | 13 | 19.51 | Intron+ve, ASD > 4, Normals < 2, no Sanger filter applied |
| 3 | 76 | 53011886 | 53014254 | 2,368 | loss | 1347 | SFMBT1 | N | 0 | 5 | 7.42 | Intron+ve, ASD > 4, Normals < 2, no Sanger filter applied |
| 3 | 76 | 53011886 | 53014254 | 2,368 | loss | 1426 | SFMBT1 | N | 0 | 5 | 7.42 | Intron+ve, ASD > 4, Normals < 2, no Sanger filter applied |
| 3 | 76 | 53011886 | 53014254 | 2,368 | loss | 1441 | SFMBT1 | N | 0 | 5 | 7.42 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 3 | 76 | 53011886 | 53014254 | 2,368 | loss | 1494 | SFMBT1 | N | 0 | 5 | 7.42 | Intron+ve, ASD > 4, Normals < 2, no Sanger filter applied |
| 3 | 76 | 53011886 | 53014254 | 2,368 | loss | 1784 | SFMBT1 | N | 0 | 5 | 7.42 | Intron+ve, ASD > 4, Normals < 2, no Sanger filter applied |
| 3 | 77 | 56583582 | 56591797 | 8,215 | loss | 1417 | CCDC66 | N | 1 | 6 | 8.91 | Intron+ve, ASD > 4, Normals < 2, no Sanger filter applied |
| 3 | 77 | 56583582 | 56591797 | 8,215 | loss | 1436 | CCDC66 | N | 1 | 6 | 8.91 | Intron+ve, ASD > 4, Normals < 2, no Sanger filter applied |
| 3 | 77 | 56583582 | 56591797 | 8,215 | loss | 1618 | CCDC66 | N | 1 | 6 | 8.91 | Intron+ve, ASD > 4, Normals < 2, no Sanger filter applied |
| 3 | 77 | 56583582 | 56591797 | 8,215 | loss | 1794 | CCDC66 | N | 1 | 6 | 8.91 | Intron+ve, ASD > 4, Normals < 2, no Sanger filter applied |
| 3 | 77 | 56583582 | 56591797 | 8,215 | loss | 1901 | CCDC66 | N | 1 | 6 | 8.91 | Intron+ve, ASD > 4, Normals < 2, no Sanger filter applied |
| 3 | 77 | 56583582 | 56591797 | 8,215 | loss | 2024 | CCDC66 | N | 1 | 6 | 8.91 | Intron+ve, ASD > 4, Normals < 2, no Sanger filter applied |
| 3 | 78 | 56591798 | 56594585 | 2,787 | loss | 1417 | CCDC66 | N | 1 | 5 | 7.42 | Intron+ve, ASD > 4, Normals < 2, no Sanger filter applied |
| 3 | 78 | 56591798 | 56594585 | 2,787 | loss | 1436 | CCDC66 | N | 1 | 5 | 7.42 | Intron+ve, ASD > 4, Normals < 2, no Sanger filter applied |
| 3 | 78 | 56591798 | 56594585 | 2,787 | loss | 1618 | CCDC66 | N | 1 | 5 | 7.42 | Intron+ve, ASD > 4, Normals < 2, no Sanger filter applied |
| 3 | 78 | 56591798 | 56594585 | 2,787 | loss | 1901 | CCDC66 | N | 1 | 5 | 7.42 | Intron+ve, ASD > 4, Normals < 2, no Sanger filter applied |
| 3 | 78 | 56591798 | 56594585 | 2,787 | loss | 2024 | CCDC66 | N | 1 | 5 | 7.42 | Intron+ve, ASD > 4, Normals < 2, no Sanger filter applied |
| 3 | 79 | 60717895 | 60719263 | 1,368 | gain | 1266 | FHIT | N | 0 | 8 | 11.92 | Intron+ve, ASD > 4, Normals < 2, no Sanger filter applied |
| 3 | 79 | 60717895 | 60719263 | 1,368 | gain | 1274 | FHIT | N | 0 | 8 | 11.92 | Intron+ve, ASD > 4, Normals < 2, no Sanger filter applied |
| 3 | 79 | 60717895 | 60719263 | 1,368 | gain | 1275 | FHIT | N | 0 | 8 | 11.92 | Intron+ve, ASD > 4, Normals < 2, no Sanger filter applied |
| 3 | 79 | 60717895 | 60719263 | 1,368 | gain | 1389 | FHIT | N | 0 | 8 | 11.92 | Intron+ve, ASD > 4, Normals < 2, no Sanger filter applied |
| 3 | 79 | 60717895 | 60719263 | 1,368 | gain | 1606 | FHIT | N | 0 | 8 | 11.92 | Intron+ve, ASD > 4, Normals < 2, no Sanger filter applied |
| 3 | 79 | 60717895 | 60719263 | 1,368 | gain | 1611 | FHIT | N | 0 | 8 | 11.92 | Intron+ve, ASD > 4, Normals < 2, no Sanger filter applied |
| 3 | 79 | 60717895 | 60719263 | 1,368 | loss | 1660 | FHIT | N | 0 | 8 | 11.92 | Intron+ve, ASD > 4, Normals < 2, no Sanger filter applied |
| 3 | 79 | 60717895 | 60719263 | 1,368 | gain | 1884 | FHIT | N | 0 | 8 | 11.92 | Intron+ve, ASD > 4, Normals < 2, no Sanger filter applied |
| 3 | 80 | 67746879 | 67748167 | 1,288 | loss | 1673 | SUCLG2 | N | 0 | 5 | 7.42 | Intron+ve, ASD > 4, Normals < 2, no Sanger filter applied |
| 3 | 80 | 67746879 | 67748167 | 1,288 | loss | 1680 | SUCLG2 | N | 0 | 5 | 7.42 | Intron+ve, ASD > 4, Normals < 2, no Sanger filter applied |
| 3 | 80 | 67746879 | 67748167 | 1,288 | loss | 1748 | SUCLG2 | N | 0 | 5 | 7.42 | Intron+ve, ASD > 4, Normals < 2, no Sanger filter applied |
| 3 | 80 | 67746879 | 67748167 | 1,288 | loss | 1940 | SUCLG2 | N | 0 | 5 | 7.42 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 3 | 80 | 67746879 | 67748167 | 1,288 | loss | 1953 | SUCLG2 | N | 0 | 5 | 7.42 | Intron+ve, ASD > 4, Normals < 2, no Sanger filter applied |
| 3 | 81 | 117168477 | 117170905 | 2,428 | loss | 1434 | LSAMP | N | 0 | 9 | 13.43 | Intron+ve, ASD > 4, Normals < 2, no Sanger filter applied |
| 3 | 81 | 117168477 | 117170905 | 2,428 | loss | 1723 | LSAMP | N | 0 | 9 | 13.43 | Intron+ve, ASD > 4, Normals < 2, no Sanger filter applied |
| 3 | 81 | 117168477 | 117170905 | 2,428 | loss | 1916 | LSAMP | N | 0 | 9 | 13.43 | Intron+ve, ASD > 4, Normals < 2, no Sanger filter applied |
| 3 | 81 | 117168477 | 117170905 | 2,428 | loss | 1958 | LSAMP | N | 0 | 9 | 13.43 | Intron+ve, ASD > 4, Normals < 2, no Sanger filter applied |
| 3 | 81 | 117168477 | 117170905 | 2,428 | loss | 1961 | LSAMP | N | 0 | 9 | 13.43 | Intron+ve, ASD > 4, Normals < 2, no Sanger filter applied |
| 3 | 81 | 117168477 | 117170905 | 2,428 | loss | 1963 | LSAMP | N | 0 | 9 | 13.43 | Intron+ve, ASD > 4, Normals < 2, no Sanger filter applied |
| 3 | 81 | 117168477 | 117170905 | 2,428 | loss | 1966 | LSAMP | N | 0 | 9 | 13.43 | Intron+ve, ASD > 4, Normals < 2, no Sanger filter applied |
| 3 | 81 | 117168477 | 117170905 | 2,428 | loss | 1967 | LSAMP | N | 0 | 9 | 13.43 | Intron+ve, ASD > 4, Normals < 2, no Sanger filter applied |
| 3 | 81 | 117168477 | 117170905 | 2,428 | loss | 1969 | LSAMP | N | 0 | 9 | 13.43 | Intron+ve, ASD > 4, Normals < 2, no Sanger filter applied |
| 3 | 82 | 156831184 | 156832789 | 1,605 | loss | 1224 | PLCH1 | N | 1 | 5 | 7.42 | Intron+ve, ASD > 4, Normals < 2, no Sanger filter applied |
| 3 | 82 | 156831184 | 156832789 | 1,605 | loss | 1548 | PLCH1 | N | 1 | 5 | 7.42 | Intron+ve, ASD > 4, Normals < 2, no Sanger filter applied |
| 3 | 82 | 156831184 | 156832789 | 1,605 | loss | 1707 | PLCH1 | N | 1 | 5 | 7.42 | Intron+ve, ASD > 4, Normals < 2, no Sanger filter applied |
| 3 | 82 | 156831184 | 156832789 | 1,605 | loss | 1729 | PLCH1 | N | 1 | 5 | 7.42 | Intron+ve, ASD > 4, Normals < 2, no Sanger filter applied |
| 3 | 82 | 156831184 | 156832789 | 1,605 | loss | 2023 | PLCH1 | N | 1 | 5 | 7.42 | Intron+ve, ASD > 4, Normals < 2, no Sanger filter applied |
| 3 | 83 | 168466681 | 168466714 | 33 | gain | 1394 | ZBBX | N | 0 | 11 | 16.46 | Intron+ve, ASD > 4, Normals < 2, no Sanger filter applied |
| 3 | 83 | 168466681 | 168466714 | 33 | gain | 1395 | ZBBX | N | 0 | 11 | 16.46 | Intron+ve, ASD > 4, Normals < 2, no Sanger filter applied |
| 3 | 83 | 168466681 | 168466714 | 33 | gain | 1396 | ZBBX | N | 0 | 11 | 16.46 | Intron+ve, ASD > 4, Normals < 2, no Sanger filter applied |
| 3 | 83 | 168466681 | 168466714 | 33 | gain | 1432 | ZBBX | N | 0 | 11 | 16.46 | Intron+ve, ASD > 4, Normals < 2, no Sanger filter applied |
| 3 | 83 | 168466681 | 168466714 | 33 | gain | 1434 | ZBBX | N | 0 | 11 | 16.46 | Intron+ve, ASD > 4, Normals < 2, no Sanger filter applied |
| 3 | 83 | 168466681 | 168466714 | 33 | gain | 1570 | ZBBX | N | 0 | 11 | 16.46 | Intron+ve, ASD > 4, Normals < 2, no Sanger filter applied |
| 3 | 83 | 168466681 | 168466714 | 33 | gain | 1573 | ZBBX | N | 0 | 11 | 16.46 | Intron+ve, ASD > 4, Normals < 2, no Sanger filter applied |
| 3 | 83 | 168466681 | 168466714 | 33 | gain | 1620 | ZBBX | N | 0 | 11 | 16.46 | Intron+ve, ASD > 4, Normals < 2, no Sanger filter applied |
| 3 | 83 | 168466681 | 168466714 | 33 | gain | 1865 | ZBBX | N | 0 | 11 | 16.46 | Intron+ve, ASD > 4, Normals < 2, no Sanger filter applied |
| 3 | 83 | 168466681 | 168466714 | 33 | gain | 1884 | ZBBX | N | 0 | 11 | 16.46 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 3 | 83 | 168466681 | 168466714 | 33 | gain | 1908 | ZBBX | N | 0 | 11 | 16.46 | Intron+ve, ASD > 4, Normals < 2, no Sanger filter applied |
| 3 | 84 | 192544305 | 192546279 | 1,974 | loss | 1251 | CCDC50 | N | 1 | 7 | 10.41 | Intron+ve, ASD > 4, Normals < 2, no Sanger filter applied |
| 3 | 84 | 192544305 | 192546279 | 1,974 | loss | 1284 | CCDC50 | N | 1 | 7 | 10.41 | Intron+ve, ASD > 4, Normals < 2, no Sanger filter applied |
| 3 | 84 | 192544305 | 192546279 | 1,974 | loss | 1401 | CCDC50 | N | 1 | 7 | 10.41 | Intron+ve, ASD > 4, Normals < 2, no Sanger filter applied |
| 3 | 84 | 192544305 | 192546279 | 1,974 | loss | 1657 | CCDC50 | N | 1 | 7 | 10.41 | Intron+ve, ASD > 4, Normals < 2, no Sanger filter applied |
| 3 | 84 | 192544305 | 192546279 | 1,974 | loss | 1697 | CCDC50 | N | 1 | 7 | 10.41 | Intron+ve, ASD > 4, Normals < 2, no Sanger filter applied |
| 3 | 84 | 192544305 | 192546279 | 1,974 | loss | 1803 | CCDC50 | N | 1 | 7 | 10.41 | Intron+ve, ASD > 4, Normals < 2, no Sanger filter applied |
| 3 | 84 | 192544305 | 192546279 | 1,974 | loss | 1884 | CCDC50 | N | 1 | 7 | 10.41 | Intron+ve, ASD > 4, Normals < 2, no Sanger filter applied |
| 3 | 85 | 197412253 | 197422859 | 10,606 | gain | 1227 | ZDHHC19 | Y | 1 | 2 | 2.95 | Exon+ve, 5 > ASD > 1, Normals < 2, Sanger-ve |
| 3 | 85 | 197412253 | 197422859 | 10,606 | gain | 1565 | ZDHHC19 | Y | 1 | 2 | 2.95 | Exon+ve, 5 > ASD > 1, Normals < 2, Sanger-ve |
| 3 | 86 | 197488773 | 197516473 | 27,700 | gain | 1227 | PCYT1A, TCTEX1D2 | Y | 1 | 2 | 2.95 | Exon+ve, 5 > ASD > 1, Normals < 2, Sanger-ve |
| 3 | 86 | 197488773 | 197516473 | 27,700 | gain | 1565 | PCYT1A, TCTEX1D2 | Y | 1 | 2 | 2.95 | Exon+ve, 5 > ASD > 1, Normals < 2, Sanger-ve |
| 4 | 87 | 69165815 | 69643272 | 477,457 | gain | 1239 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1268 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1277 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | loss | 1291 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1387 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1417 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1447 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1451 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1548 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | loss | 1555 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1578 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1588 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1657 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1665 | UGT2B15, TMPRSS11E | Y | 1 | 30 | 46.2 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 4 | 87 | 69165815 | 69643272 | 477,457 | gain | 1667 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1669 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1672 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1694 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | loss | 1714 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | loss | 1715 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1761 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1833 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1842 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1860 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1885 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1894 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1911 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 1952 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 2001 | UGT2B15, TMPRSS11E | Y | 1 | 30 | 46.2 | Exon+ve, ASD > 4, Normals < 2, no Sanger filter applied |
| 4 | 87 | 69165815 | 69643272 | 477,457 | gain | 2030 | UGT2B15, TMPRSS11E | Y | 1 | 30 | 46.2 | Exon+ve, ASD > 4, Normals < 2, no Sanger filter applied |
| 4 | 88 | 71197387 | 71263279 | 65,892 | loss | 1242 | CABS1, SMR3A | Y | 1 | 2 | 2.95 | Exon+ve, 5 > ASD > 1, Normals < 2, Sanger-ve |
| 4 | 88 | 71197387 | 71263279 | 65,892 | loss | 1860 | CABS1, SMR3A | Y | 1 | 2 | 2.95 | Exon+ve, 5 > ASD > 1, Normals < 2, Sanger-ve |
| 4 | 89 | 71263280 | 71284124 | 20,844 | loss | 1242 | SMR3B, SMR3A | Y | 1 | 3 | 4.44 | Exon+ve, 5 > ASD > 1, Normals < 2, Sanger-ve |
| 4 | 89 | 71263280 | 71284124 | 20,844 | loss | 1537 | SMR3B, SMR3A | Y | 1 | 3 | 4.44 | Exon+ve, 5 > ASD > 1, Normals < 2, Sanger-ve |
| 4 | 89 | 71263280 | 71284124 | 20,844 | loss | 1860 | SMR3B, SMR3A | Y | 1 | 3 | 4.44 | Exon+ve, 5 > ASD > 1, Normals < 2, Sanger-ve |
| 4 | 90 | 71284125 | 71318078 | 33,953 | loss | 1242 | PROL1, SMR3B | Y | 1 | 2 | 2.95 | Exon+ve, 5 > ASD > 1, Normals < 2, Sanger-ve |
| 4 | 90 | 71284125 | 71318078 | 33,953 | loss | 1860 | PROL1, SMR3B | Y | 1 | 2 | 2.95 | Exon+ve, 5 > ASD > 1, Normals < 2, Sanger-ve |
| 4 | 91 | 94589345 | 94590778 | 1,433 | loss | 1391 | GRID2 | N | 0 | 6 | 8.91 | Intron+ve, ASD > 4, Normals < 2, no Sanger filter applied |
| 4 | 91 | 94589345 | 94590778 | 1,433 | loss | 1418 | GRID2 | N | 0 | 6 | 8.91 | Intron+ve, ASD > 4, Normals < 2, no Sanger filter applied |
| 4 | 91 | 94589345 | 94590778 | 1,433 | loss | 1724 | GRID2 | N | 0 | 6 | 8.91 | Intron+ve, ASD > 4, Normals < 2, no Sanger filter applied |
| 4 | 91 | 94589345 | 94590778 | 1,433 | loss | 1777 | GRID2 | N | 0 | 6 | 8.91 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 4 | 91 | 94589345 | 94590778 | 1,433 | loss | 1821 | GRID2 | N | 0 | 6 | 8.91 | Intron+ve, ASD > 4, Normals < 2, no Sanger filter applied |
| 4 | 91 | 94589345 | 94590778 | 1,433 | loss | 1864 | GRID2 | N | 0 | 6 | 8.91 | Intron+ve, ASD > 4, Normals < 2, no Sanger filter applied |
| 4 | 92 | 119333528 | 119333700 | 172 | loss | 1234 | NDST3 | N | 0 | 18 | 27.22 | Intron+ve, ASD > 4, Normals < 2, no Sanger filter applied |
| 4 | 92 | 119333528 | 119333700 | 172 | loss | 1307 | NDST3 | N | 0 | 18 | 27.22 | Intron+ve, ASD > 4, Normals < 2, no Sanger filter applied |
| 4 | 92 | 119333528 | 119333700 | 172 | loss | 1392 | NDST3 | N | 0 | 18 | 27.22 | Intron+ve, ASD > 4, Normals < 2, no Sanger filter applied |
| 4 | 92 | 119333528 | 119333700 | 172 | loss | 1413 | NDST3 | N | 0 | 18 | 27.22 | Intron+ve, ASD > 4, Normals < 2, no Sanger filter applied |
| 4 | 92 | 119333528 | 119333700 | 172 | loss | 1428 | NDST3 | N | 0 | 18 | 27.22 | Intron+ve, ASD > 4, Normals < 2, no Sanger filter applied |
| 4 | 92 | 119333528 | 119333700 | 172 | loss | 1560 | NDST3 | N | 0 | 18 | 27.22 | Intron+ve, ASD > 4, Normals < 2, no Sanger filter applied |
| 4 | 92 | 119333528 | 119333700 | 172 | loss | 1753 | NDST3 | N | 0 | 18 | 27.22 | Intron+ve, ASD > 4, Normals < 2, no Sanger filter applied |
| 4 | 92 | 119333528 | 119333700 | 172 | loss | 1798 | NDST3 | N | 0 | 18 | 27.22 | Intron+ve, ASD > 4, Normals < 2, no Sanger filter applied |
| 4 | 92 | 119333528 | 119333700 | 172 | loss | 1800 | NDST3 | N | 0 | 18 | 27.22 | Intron+ve, ASD > 4, Normals < 2, no Sanger filter applied |
| 4 | 92 | 119333528 | 119333700 | 172 | loss | 1884 | NDST3 | N | 0 | 18 | 27.22 | Intron+ve, ASD > 4, Normals < 2, no Sanger filter applied |
| 4 | 92 | 119333528 | 119333700 | 172 | loss | 1894 | NDST3 | N | 0 | 18 | 27.22 | Intron+ve, ASD > 4, Normals < 2, no Sanger filter applied |
| 4 | 92 | 119333528 | 119333700 | 172 | loss | 1959 | NDST3 | N | 0 | 18 | 27.22 | Intron+ve, ASD > 4, Normals < 2, no Sanger filter applied |
| 4 | 92 | 119333528 | 119333700 | 172 | loss | 1962 | NDST3 | N | 0 | 18 | 27.22 | Intron+ve, ASD > 4, Normals < 2, no Sanger filter applied |
| 4 | 92 | 119333528 | 119333700 | 172 | loss | 1966 | NDST3 | N | 0 | 18 | 27.22 | Intron+ve, ASD > 4, Normals < 2, no Sanger filter applied |
| 4 | 92 | 119333528 | 119333700 | 172 | loss | 1969 | NDST3 | N | 0 | 18 | 27.22 | Intron+ve, ASD > 4, Normals < 2, no Sanger filter applied |
| 4 | 92 | 119333528 | 119333700 | 172 | loss | 2023 | NDST3 | N | 0 | 18 | 27.22 | Intron+ve, ASD > 4, Normals < 2, no Sanger filter applied |
| 4 | 92 | 119333528 | 119333700 | 172 | loss | 2034 | NDST3 | N | 0 | 18 | 27.22 | Intron+ve, ASD > 4, Normals < 2, no Sanger filter applied |
| 4 | 92 | 119333528 | 119333700 | 172 | loss | 2042 | NDST3 | N | 0 | 18 | 27.22 | Intron+ve, ASD > 4, Normals < 2, no Sanger filter applied |
| 4 | 93 | 119333701 | 119334953 | 1,252 | loss | 1234 | NDST3 | N | 0 | 20 | 30.33 | Intron+ve, ASD > 4, Normals < 2, no Sanger filter applied |
| 4 | 93 | 119333701 | 119334953 | 1,252 | loss | 1307 | NDST3 | N | 0 | 20 | 30.33 | Intron+ve, ASD > 4, Normals < 2, no Sanger filter applied |
| 4 | 93 | 119333701 | 119334953 | 1,252 | loss | 1392 | NDST3 | N | 0 | 20 | 30.33 | Intron+ve, ASD > 4, Normals < 2, no Sanger filter applied |
| 4 | 93 | 119333701 | 119334953 | 1,252 | loss | 1413 | NDST3 | N | 0 | 20 | 30.33 | Intron+ve, ASD > 4, Normals < 2, no Sanger filter applied |
| 4 | 93 | 119333701 | 119334953 | 1,252 | loss | 1428 | NDST3 | N | 0 | 20 | 30.33 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 4 | 93 | 119333701 | 119334953 | 1,252 | loss | 1560 | NDST3 | N | 0 | 20 | 30.33 | Intron+ve, ASD > 4, Normals < 2, no Sanger filter applied |
| 4 | 93 | 119333701 | 119334953 | 1,252 | loss | 1718 | NDST3 | N | 0 | 20 | 30.33 | Intron+ve, ASD > 4, Normals < 2, no Sanger filter applied |
| 4 | 93 | 119333701 | 119334953 | 1,252 | loss | 1753 | NDST3 | N | 0 | 20 | 30.33 | Intron+ve, ASD > 4, Normals < 2, no Sanger filter applied |
| 4 | 93 | 119333701 | 119334953 | 1,252 | loss | 1798 | NDST3 | N | 0 | 20 | 30.33 | Intron+ve, ASD > 4, Normals < 2, no Sanger filter applied |
| 4 | 93 | 119333701 | 119334953 | 1,252 | loss | 1800 | NDST3 | N | 0 | 20 | 30.33 | Intron+ve, ASD > 4, Normals < 2, no Sanger filter applied |
| 4 | 93 | 119333701 | 119334953 | 1,252 | loss | 1859 | NDST3 | N | 0 | 20 | 30.33 | Intron+ve, ASD > 4, Normals < 2, no Sanger filter applied |
| 4 | 93 | 119333701 | 119334953 | 1,252 | loss | 1884 | NDST3 | N | 0 | 20 | 30.33 | Intron+ve, ASD > 4, Normals < 2, no Sanger filter applied |
| 4 | 93 | 119333701 | 119334953 | 1,252 | loss | 1894 | NDST3 | N | 0 | 20 | 30.33 | Intron+ve, ASD > 4, Normals < 2, no Sanger filter applied |
| 4 | 93 | 119333701 | 119334953 | 1,252 | loss | 1959 | NDST3 | N | 0 | 20 | 30.33 | Intron+ve, ASD > 4, Normals < 2, no Sanger filter applied |
| 4 | 93 | 119333701 | 119334953 | 1,252 | loss | 1962 | NDST3 | N | 0 | 20 | 30.33 | Intron+ve, ASD > 4, Normals < 2, no Sanger filter applied |
| 4 | 93 | 119333701 | 119334953 | 1,252 | loss | 1966 | NDST3 | N | 0 | 20 | 30.33 | Intron+ve, ASD > 4, Normals < 2, no Sanger filter applied |
| 4 | 93 | 119333701 | 119334953 | 1,252 | loss | 1969 | NDST3 | N | 0 | 20 | 30.33 | Intron+ve, ASD > 4, Normals < 2, no Sanger filter applied |
| 4 | 93 | 119333701 | 119334953 | 1,252 | loss | 2023 | NDST3 | N | 0 | 20 | 30.33 | Intron+ve, ASD > 4, Normals < 2, no Sanger filter applied |
| 4 | 93 | 119333701 | 119334953 | 1,252 | loss | 2034 | NDST3 | N | 0 | 20 | 30.33 | Intron+ve, ASD > 4, Normals < 2, no Sanger filter applied |
| 4 | 93 | 119333701 | 119334953 | 1,252 | loss | 2042 | NDST3 | N | 0 | 20 | 30.33 | Intron+ve, ASD > 4, Normals < 2, no Sanger filter applied |
| 4 | 94 | 119334954 | 119345370 | 10,416 | loss | 1234 | NDST3 | N | 0 | 28 | 42.98 | Intron+ve, ASD > 4, Normals < 2, no Sanger filter applied |
| 4 | 94 | 119334954 | 119345370 | 10,416 | loss | 1290 | NDST3 | N | 0 | 28 | 42.98 | Intron+ve, ASD > 4, Normals < 2, no Sanger filter applied |
| 4 | 94 | 119334954 | 119345370 | 10,416 | loss | 1307 | NDST3 | N | 0 | 28 | 42.98 | Intron+ve, ASD > 4, Normals < 2, no Sanger filter applied |
| 4 | 94 | 119334954 | 119345370 | 10,416 | loss | 1392 | NDST3 | N | 0 | 28 | 42.98 | Intron+ve, ASD > 4, Normals < 2, no Sanger filter applied |
| 4 | 94 | 119334954 | 119345370 | 10,416 | loss | 1413 | NDST3 | N | 0 | 28 | 42.98 | Intron+ve, ASD > 4, Normals < 2, no Sanger filter applied |
| 4 | 94 | 119334954 | 119345370 | 10,416 | loss | 1428 | NDST3 | N | 0 | 28 | 42.98 | Intron+ve, ASD > 4, Normals < 2, no Sanger filter applied |
| 4 | 94 | 119334954 | 119345370 | 10,416 | loss | 1560 | NDST3 | N | 0 | 28 | 42.98 | Intron+ve, ASD > 4, Normals < 2, no Sanger filter applied |
| 4 | 94 | 119334954 | 119345370 | 10,416 | loss | 1629 | NDST3 | N | 0 | 28 | 42.98 | Intron+ve, ASD > 4, Normals < 2, no Sanger filter applied |
| 4 | 94 | 119334954 | 119345370 | 10,416 | loss | 1659 | NDST3 | N | 0 | 28 | 42.98 | Intron+ve, ASD > 4, Normals < 2, no Sanger filter applied |
| 4 | 94 | 119334954 | 119345370 | 10,416 | loss | 1708 | NDST3 | N | 0 | 28 | 42.98 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 4 | 94 | 119334954 | 119345370 | 10,416 | loss | 1718 | NDST3 | N | 0 | 28 | 42.98 | Intron+ve, ASD > 4, Normals < 2, no Sanger filter applied |
| 4 | 94 | 119334954 | 119345370 | 10,416 | loss | 1720 | NDST3 | N | 0 | 28 | 42.98 | Intron+ve, ASD > 4, Normals < 2, no Sanger filter applied |
| 4 | 94 | 119334954 | 119345370 | 10,416 | loss | 1753 | NDST3 | N | 0 | 28 | 42.98 | Intron+ve, ASD > 4, Normals < 2, no Sanger filter applied |
| 4 | 94 | 119334954 | 119345370 | 10,416 | loss | 1798 | NDST3 | N | 0 | 28 | 42.98 | Intron+ve, ASD > 4, Normals < 2, no Sanger filter applied |
| 4 | 94 | 119334954 | 119345370 | 10,416 | loss | 1800 | NDST3 | N | 0 | 28 | 42.98 | Intron+ve, ASD > 4, Normals < 2, no Sanger filter applied |
| 4 | 94 | 119334954 | 119345370 | 10,416 | loss | 1824 | NDST3 | N | 0 | 28 | 42.98 | Intron+ve, ASD > 4, Normals < 2, no Sanger filter applied |
| 4 | 94 | 119334954 | 119345370 | 10,416 | loss | 1859 | NDST3 | N | 0 | 28 | 42.98 | Intron+ve, ASD > 4, Normals < 2, no Sanger filter applied |
| 4 | 94 | 119334954 | 119345370 | 10,416 | loss | 1884 | NDST3 | N | 0 | 28 | 42.98 | Intron+ve, ASD > 4, Normals < 2, no Sanger filter applied |
| 4 | 94 | 119334954 | 119345370 | 10,416 | loss | 1894 | NDST3 | N | 0 | 28 | 42.98 | Intron+ve, ASD > 4, Normals < 2, no Sanger filter applied |
| 4 | 94 | 119334954 | 119345370 | 10,416 | loss | 1946 | NDST3 | N | 0 | 28 | 42.98 | Intron+ve, ASD > 4, Normals < 2, no Sanger filter applied |
| 4 | 94 | 119334954 | 119345370 | 10,416 | loss | 1959 | NDST3 | N | 0 | 28 | 42.98 | Intron+ve, ASD > 4, Normals < 2, no Sanger filter applied |
| 4 | 94 | 119334954 | 119345370 | 10,416 | loss | 1962 | NDST3 | N | 0 | 28 | 42.98 | Intron+ve, ASD > 4, Normals < 2, no Sanger filter applied |
| 4 | 94 | 119334954 | 119345370 | 10,416 | loss | 1966 | NDST3 | N | 0 | 28 | 42.98 | Intron+ve, ASD > 4, Normals < 2, no Sanger filter applied |
| 4 | 94 | 119334954 | 119345370 | 10,416 | loss | 1969 | NDST3 | N | 0 | 28 | 42.98 | Intron+ve, ASD > 4, Normals < 2, no Sanger filter applied |
| 4 | 94 | 119334954 | 119345370 | 10,416 | loss | 2020 | NDST3 | N | 0 | 28 | 42.98 | Intron+ve, ASD > 4, Normals < 2, no Sanger filter applied |
| 4 | 94 | 119334954 | 119345370 | 10,416 | loss | 2023 | NDST3 | N | 0 | 28 | 42.98 | Intron+ve, ASD > 4, Normals < 2, no Sanger filter applied |
| 4 | 94 | 119334954 | 119345370 | 10,416 | loss | 2034 | NDST3 | N | 0 | 28 | 42.98 | Intron+ve, ASD > 4, Normals < 2, no Sanger filter applied |
| 4 | 94 | 119334954 | 119345370 | 10,416 | loss | 2042 | NDST3 | N | 0 | 28 | 42.98 | Intron+ve, ASD > 4, Normals < 2, no Sanger filter applied |
| 4 | 95 | 129950848 | 129952427 | 1,579 | gain | 1261 | PHF17 | N | 0 | 18 | 27.22 | Intron+ve, ASD > 4, Normals < 2, no Sanger filter applied |
| 4 | 95 | 129950848 | 129952427 | 1,579 | gain | 1272 | PHF17 | N | 0 | 18 | 27.22 | Intron+ve, ASD > 4, Normals < 2, no Sanger filter applied |
| 4 | 95 | 129950848 | 129952427 | 1,579 | gain | 1542 | PHF17 | N | 0 | 18 | 27.22 | Intron+ve, ASD > 4, Normals < 2, no Sanger filter applied |
| 4 | 95 | 129950848 | 129952427 | 1,579 | loss | 1572 | PHF17 | N | 0 | 18 | 27.22 | Intron+ve, ASD > 4, Normals < 2, no Sanger filter applied |
| 4 | 95 | 129950848 | 129952427 | 1,579 | gain | 1585 | PHF17 | N | 0 | 18 | 27.22 | Intron+ve, ASD > 4, Normals < 2, no Sanger filter applied |
| 4 | 95 | 129950848 | 129952427 | 1,579 | gain | 1696 | PHF17 | N | 0 | 18 | 27.22 | Intron+ve, ASD > 4, Normals < 2, no Sanger filter applied |
| 4 | 95 | 129950848 | 129952427 | 1,579 | loss | 1703 | PHF17 | N | 0 | 18 | 27.22 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 4 | 95 | 129950848 | 129952427 | 1,579 | gain | 1710 | PHF17 | N | 0 | 18 | 27.22 | Intron+ve, ASD > 4, Normals < 2, no Sanger filter applied |
| 4 | 95 | 129950848 | 129952427 | 1,579 | loss | 1721 | PHF17 | N | 0 | 18 | 27.22 | Intron+ve, ASD > 4, Normals < 2, no Sanger filter applied |
| 4 | 95 | 129950848 | 129952427 | 1,579 | loss | 1724 | PHF17 | N | 0 | 18 | 27.22 | Intron+ve, ASD > 4, Normals < 2, no Sanger filter applied |
| 4 | 95 | 129950848 | 129952427 | 1,579 | gain | 1743 | PHF17 | N | 0 | 18 | 27.22 | Intron+ve, ASD > 4, Normals < 2, no Sanger filter applied |
| 4 | 95 | 129950848 | 129952427 | 1,579 | gain | 1776 | PHF17 | N | 0 | 18 | 27.22 | Intron+ve, ASD > 4, Normals < 2, no Sanger filter applied |
| 4 | 95 | 129950848 | 129952427 | 1,579 | gain | 1818 | PHF17 | N | 0 | 18 | 27.22 | Intron+ve, ASD > 4, Normals < 2, no Sanger filter applied |
| 4 | 95 | 129950848 | 129952427 | 1,579 | gain | 1860 | PHF17 | N | 0 | 18 | 27.22 | Intron+ve, ASD > 4, Normals < 2, no Sanger filter applied |
| 4 | 95 | 129950848 | 129952427 | 1,579 | loss | 1883 | PHF17 | N | 0 | 18 | 27.22 | Intron+ve, ASD > 4, Normals < 2, no Sanger filter applied |
| 4 | 95 | 129950848 | 129952427 | 1,579 | gain | 1908 | PHF17 | N | 0 | 18 | 27.22 | Intron+ve, ASD > 4, Normals < 2, no Sanger filter applied |
| 4 | 95 | 129950848 | 129952427 | 1,579 | loss | 2031 | PHF17 | N | 0 | 18 | 27.22 | Intron+ve, ASD > 4, Normals < 2, no Sanger filter applied |
| 4 | 95 | 129950848 | 129952427 | 1,579 | loss | 2044 | PHF17 | N | 0 | 18 | 27.22 | Intron+ve, ASD > 4, Normals < 2, no Sanger filter applied |
| 4 | 96 | 145242544 | 145255693 | 13,149 | gain | 1426 | GYPA | Y | 1 | 3 | 4.44 | Exon+ve, 5 > ASD > 1, Normals < 2, Sanger−ve |
| 4 | 96 | 145242544 | 145255693 | 13,149 | gain | 1677 | GYPA | Y | 1 | 3 | 4.44 | Exon+ve, 5 > ASD > 1, Normals < 2, Sanger−ve |
| 4 | 96 | 145242544 | 145255693 | 13,149 | gain | 1929 | GYPA | Y | 1 | 3 | 4.44 | Exon+ve, 5 > ASD > 1, Normals < 2, Sanger−ve |
| 4 | 97 | 173659100 | 173660684 | 1,584 | gain | 1230 | GALNTL6 | N | 1 | 6 | 8.91 | Intron+ve, ASD > 4, Normals < 2, no Sanger filter applied |
| 4 | 97 | 173659100 | 173660684 | 1,584 | gain | 1250 | GALNTL6 | N | 1 | 6 | 8.91 | Intron+ve, ASD > 4, Normals < 2, no Sanger filter applied |
| 4 | 97 | 173659100 | 173660684 | 1,584 | gain | 1396 | GALNTL6 | N | 1 | 6 | 8.91 | Intron+ve, ASD > 4, Normals < 2, no Sanger filter applied |
| 4 | 97 | 173659100 | 173660684 | 1,584 | gain | 1798 | GALNTL6 | N | 1 | 6 | 8.91 | Intron+ve, ASD > 4, Normals < 2, no Sanger filter applied |
| 4 | 97 | 173659100 | 173660684 | 1,584 | gain | 1834 | GALNTL6 | N | 1 | 6 | 8.91 | Intron+ve, ASD > 4, Normals < 2, no Sanger filter applied |
| 4 | 97 | 173659100 | 173660684 | 1,584 | gain | 2034 | GALNTL6 | N | 1 | 6 | 8.91 | Intron+ve, ASD > 4, Normals < 2, no Sanger filter applied |
| 4 | 98 | 173660685 | 173663053 | 2,368 | gain | 1230 | GALNTL6 | N | 0 | 6 | 8.91 | Intron+ve, ASD > 4, Normals < 2, no Sanger filter applied |
| 4 | 98 | 173660685 | 173663053 | 2,368 | gain | 1250 | GALNTL6 | N | 0 | 6 | 8.91 | Intron+ve, ASD > 4, Normals < 2, no Sanger filter applied |
| 4 | 98 | 173660685 | 173663053 | 2,368 | gain | 1396 | GALNTL6 | N | 0 | 6 | 8.91 | Intron+ve, ASD > 4, Normals < 2, no Sanger filter applied |
| 4 | 98 | 173660685 | 173663053 | 2,368 | gain | 1798 | GALNTL6 | N | 0 | 6 | 8.91 | Intron+ve, ASD > 4, Normals < 2, no Sanger filter applied |
| 4 | 98 | 173660685 | 173663053 | 2,368 | gain | 1834 | GALNTL6 | N | 0 | 6 | 8.91 | Intron+ve, ASD > 4, Normals < 2, no Sanger filter applied |
| 4 | 98 | 173660685 | 173663053 | 2,368 | gain | 2034 | GALNTL6 | N | 0 | 6 | 8.91 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 4 | 99 | 175860235 | 175862083 | 1,848 | gain | 1288 | GLRA3 | N | 0 | 9 | 13.43 | Intron+ve, ASD > 4, Normals < 2, no Sanger filter applied |
| 4 | 99 | 175860235 | 175862083 | 1,848 | gain | 1534 | GLRA3 | N | 0 | 9 | 13.43 | Intron+ve, ASD > 4, Normals < 2, no Sanger filter applied |
| 4 | 99 | 175860235 | 175862083 | 1,848 | gain | 1570 | GLRA3 | N | 0 | 9 | 13.43 | Intron+ve, ASD > 4, Normals < 2, no Sanger filter applied |
| 4 | 99 | 175860235 | 175862083 | 1,848 | gain | 1571 | GLRA3 | N | 0 | 9 | 13.43 | Intron+ve, ASD > 4, Normals < 2, no Sanger filter applied |
| 4 | 99 | 175860235 | 175862083 | 1,848 | gain | 1821 | GLRA3 | N | 0 | 9 | 13.43 | Intron+ve, ASD > 4, Normals < 2, no Sanger filter applied |
| 4 | 99 | 175860235 | 175862083 | 1,848 | gain | 1860 | GLRA3 | N | 0 | 9 | 13.43 | Intron+ve, ASD > 4, Normals < 2, no Sanger filter applied |
| 4 | 99 | 175860235 | 175862083 | 1,848 | gain | 1914 | GLRA3 | N | 0 | 9 | 13.43 | Intron+ve, ASD > 4, Normals < 2, no Sanger filter applied |
| 4 | 99 | 175860235 | 175862083 | 1,848 | gain | 1931 | GLRA3 | N | 0 | 9 | 13.43 | Intron+ve, ASD > 4, Normals < 2, no Sanger filter applied |
| 4 | 99 | 175860235 | 175862083 | 1,848 | gain | 2032 | GLRA3 | N | 0 | 9 | 13.43 | Intron+ve, ASD > 4, Normals < 2, no Sanger filter applied |
| 4 | 100 | 189229198 | 189255442 | 26,244 | loss | 1619 | TRIML2 | Y | 1 | 3 | 4.44 | Exon+ve, 5 > ASD > 1, Normals < 2, Sanger-ve |
| 4 | 100 | 189229198 | 189255442 | 26,244 | gain | 1691 | TRIML2 | Y | 1 | 3 | 4.44 | Exon+ve, 5 > ASD > 1, Normals < 2, Sanger-ve |
| 4 | 100 | 189229198 | 189255442 | 26,244 | gain | 1704 | TRIML2 | Y | 1 | 3 | 4.44 | Exon+ve, 5 > ASD > 1, Normals < 2, Sanger-ve |
| 4 | 101 | 189255443 | 189277552 | 22,109 | gain | 1691 | TRIML2 | Y | 1 | 2 | 2.95 | Exon+ve, 5 > ASD > 1, Normals < 2, Sanger-ve |
| 4 | 101 | 189255443 | 189277552 | 22,109 | gain | 1704 | TRIML2 | Y | 1 | 2 | 2.95 | Exon+ve, 5 > ASD > 1, Normals < 2, Sanger-ve |
| 4 | 102 | 189759097 | 189816040 | 56,943 | loss | 1499 | LOC401164 | Y | 1 | 3 | 4.44 | Exon+ve, 5 > ASD > 1, Normals < 2, Sanger-ve |
| 4 | 102 | 189759097 | 189816040 | 56,943 | gain | 1534 | LOC401164 | Y | 1 | 3 | 4.44 | Exon+ve, 5 > ASD > 1, Normals < 2, Sanger-ve |
| 4 | 102 | 189759097 | 189816040 | 56,943 | gain | 1691 | LOC401164 | Y | 1 | 3 | 4.44 | Exon+ve, 5 > ASD > 1, Normals < 2, Sanger-ve |
| 4 | 103 | 191133836 | 191153613 | 19,777 | gain | 1230 | TUBB4Q | Y | 1 | 3 | 4.44 | Exon+ve, 5 > ASD > 1, Normals < 2, Sanger-ve |
| 4 | 103 | 191133836 | 191153613 | 19,777 | gain | 1292 | TUBB4Q | Y | 1 | 3 | 4.44 | Exon+ve, 5 > ASD > 1, Normals < 2, Sanger-ve |
| 4 | 103 | 191133836 | 191153613 | 19,777 | loss | 1696 | TUBB4Q | Y | 1 | 3 | 4.44 | Exon+ve, 5 > ASD > 1, Normals < 2, Sanger-ve |
| 5 | 104 | 10683077 | 10688336 | 5,259 | loss | 1438 | ANKRD33B | N | 0 | 13 | 19.51 | Intron+ve, ASD > 4, Normals < 2, no Sanger filter applied |
| 5 | 104 | 10683077 | 10688336 | 5,259 | loss | 1619 | ANKRD33B | N | 0 | 13 | 19.51 | Intron+ve, ASD > 4, Normals < 2, no Sanger filter applied |
| 5 | 104 | 10683077 | 10688336 | 5,259 | loss | 1629 | ANKRD33B | N | 0 | 13 | 19.51 | Intron+ve, ASD > 4, Normals < 2, no Sanger filter applied |
| 5 | 104 | 10683077 | 10688336 | 5,259 | loss | 1630 | ANKRD33B | N | 0 | 13 | 19.51 | Intron+ve, ASD > 4, Normals < 2, no Sanger filter applied |
| 5 | 104 | 10683077 | 10688336 | 5,259 | loss | 1666 | ANKRD33B | N | 0 | 13 | 19.51 | Intron+ve, ASD > 4, Normals < 2, no Sanger filter applied |
| 5 | 104 | 10683077 | 10688336 | 5,259 | loss | 1696 | ANKRD33B | N | 0 | 13 | 19.51 | Intron+ve, ASD > 4, Normals < 2, no Sanger filter applied |
| 5 | 104 | 10683077 | 10688336 | 5,259 | loss | 1850 | ANKRD33B | N | 0 | 13 | 19.51 | Intron+ve, ASD > 4, Normals < 2, no Sanger filter applied |
| 5 | 104 | 10683077 | 10688336 | 5,259 | loss | 1916 | ANKRD33B | N | 0 | 13 | 19.51 | Intron+ve, ASD > 4, Normals < 2, no Sanger filter applied |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 5 | 104 | 10683077 | 10688336 | 5,259 | loss | 1958 | ANKRD33B | N | 0 | 13 | 19.51 | Intron+ve, ASD > 4, Normals < 2, no Sanger filter applied |
| 5 | 104 | 10683077 | 10688336 | 5,259 | loss | 1965 | ANKRD33B | N | 0 | 13 | 19.51 | Intron+ve, ASD > 4, Normals < 2, no Sanger filter applied |
| 5 | 104 | 10683077 | 10688336 | 5,259 | loss | 1998 | ANKRD33B | N | 0 | 13 | 19.51 | Intron+ve, ASD > 4, Normals < 2, no Sanger filter applied |
| 5 | 104 | 10683077 | 10688336 | 5,259 | loss | 2026 | ANKRD33B | N | 0 | 13 | 19.51 | Intron+ve, ASD > 4, Normals < 2, no Sanger filter applied |
| 5 | 104 | 10683077 | 10688336 | 5,259 | loss | 2042 | ANKRD33B | N | 0 | 13 | 19.51 | Intron+ve, ASD > 4, Normals < 2, no Sanger filter applied |
| 5 | 105 | 11956462 | 11958076 | 1,614 | loss | 1850 | CTNND2 | Y | 1 | 2 | 2.95 | Exon+ve, 5 > ASD > 1, Normals < 2, Sanger−ve |
| 5 | 105 | 11956462 | 11958076 | 1,614 | gain | 1946 | CTNND2 | Y | 1 | 2 | 2.95 | Exon+ve, 5 > ASD > 1, Normals < 2, Sanger−ve |
| 5 | 106 | 136994175 | 136995509 | 1,334 | loss | 1522 | KLHL3 | N | 1 | 6 | 8.91 | Intron+ve, ASD > 4, Normals < 2, no Sanger filter applied |
| 5 | 106 | 136994175 | 136995509 | 1,334 | loss | 1671 | KLHL3 | N | 1 | 6 | 8.91 | Intron+ve, ASD > 4, Normals < 2, no Sanger filter applied |
| 5 | 106 | 136994175 | 136995509 | 1,334 | loss | 1730 | KLHL3 | N | 1 | 6 | 8.91 | Intron+ve, ASD > 4, Normals < 2, no Sanger filter applied |
| 5 | 106 | 136994175 | 136995509 | 1,334 | loss | 1742 | KLHL3 | N | 1 | 6 | 8.91 | Intron+ve, ASD > 4, Normals < 2, no Sanger filter applied |
| 5 | 106 | 136994175 | 136995509 | 1,334 | loss | 1856 | KLHL3 | N | 1 | 6 | 8.91 | Intron+ve, ASD > 4, Normals < 2, no Sanger filter applied |
| 5 | 106 | 136994175 | 136995509 | 1,334 | loss | 1917 | KLHL3 | N | 1 | 6 | 8.91 | Intron+ve, ASD > 4, Normals < 2, no Sanger filter applied |
| 5 | 107 | 138306541 | 138313486 | 6,945 | gain | 1309 | SIL1 | Y | 1 | 3 | 4.44 | Exon+ve, 5 > ASD > 1, Normals < 2, Sanger−ve |
| 5 | 107 | 138306541 | 138313486 | 6,945 | gain | 1395 | SIL1 | Y | 1 | 3 | 4.44 | Exon+ve, 5 > ASD > 1, Normals < 2, Sanger−ve |
| 5 | 107 | 138306541 | 138313486 | 6,945 | gain | 1411 | SIL1 | Y | 1 | 3 | 4.44 | Exon+ve, 5 > ASD > 1, Normals < 2, Sanger−ve |
| 5 | 108 | 140538667 | 140541178 | 2,511 | loss | 1425 | PCDHB8, PCDHB16 | Y | 1 | 11 | 16.46 | Exon+ve, ASD > 4, Normals < 2, no Sanger filter applied |
| 5 | 108 | 140538667 | 140541178 | 2,511 | loss | 1439 | PCDHB8, PCDHB16 | Y | 1 | 11 | 16.46 | Exon+ve, ASD > 4, Normals < 2, no Sanger filter applied |
| 5 | 108 | 140538667 | 140541178 | 2,511 | loss | 1441 | PCDHB8, PCDHB16 | Y | 1 | 11 | 16.46 | Exon+ve, ASD > 4, Normals < 2, no Sanger filter applied |
| 5 | 108 | 140538667 | 140541178 | 2,511 | loss | 1490 | PCDHB8, PCDHB16 | Y | 1 | 11 | 16.46 | Exon+ve, ASD > 4, Normals < 2, no Sanger filter applied |
| 5 | 108 | 140538667 | 140541178 | 2,511 | loss | 1493 | PCDHB8, PCDHB16 | Y | 1 | 11 | 16.46 | Exon+ve, ASD > 4, Normals < 2, no Sanger filter applied |
| 5 | 108 | 140538667 | 140541178 | 2,511 | loss | 1515 | PCDHB8, PCDHB16 | Y | 1 | 11 | 16.46 | Exon+ve, ASD > 4, Normals < 2, no Sanger filter applied |
| 5 | 108 | 140538667 | 140541178 | 2,511 | loss | 1555 | PCDHB8, PCDHB16 | Y | 1 | 11 | 16.46 | Exon+ve, ASD > 4, Normals < 2, no Sanger filter applied |
| 5 | 108 | 140538667 | 140541178 | 2,511 | loss | 1564 | PCDHB8, PCDHB16 | Y | 1 | 11 | 16.46 | Exon+ve, ASD > 4, Normals < 2, no Sanger filter applied |
| 5 | 108 | 140538667 | 140541178 | 2,511 | loss | 1580 | PCDHB8, PCDHB16 | Y | 1 | 11 | 16.46 | Exon+ve, ASD > 4, Normals < 2, no Sanger filter applied |
| 5 | 108 | 140538667 | 140541178 | 2,511 | loss | 1582 | PCDHB8, PCDHB16 | Y | 1 | 11 | 16.46 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 5 | 108 | 140538667 | 140541178 | 2,511 | loss | 1641 | PCDHB8, PCDHB16 | Y | 1 | 11 | 16.46 | Exon+ve, ASD > 4, Normals < 2, no Sanger filter applied |
| 5 | 109 | 147861447 | 147867311 | 5,864 | loss | 1301 | HTR4 | N | 0 | 6 | 8.91 | Intron+ve, ASD > 4, Normals < 2, no Sanger filter applied |
| 5 | 109 | 147861447 | 147867311 | 5,864 | loss | 1307 | HTR4 | N | 0 | 6 | 8.91 | Intron+ve, ASD > 4, Normals < 2, no Sanger filter applied |
| 5 | 109 | 147861447 | 147867311 | 5,864 | loss | 1395 | HTR4 | N | 0 | 6 | 8.91 | Intron+ve, ASD > 4, Normals < 2, no Sanger filter applied |
| 5 | 109 | 147861447 | 147867311 | 5,864 | loss | 1729 | HTR4 | N | 0 | 6 | 8.91 | Intron+ve, ASD > 4, Normals < 2, no Sanger filter applied |
| 5 | 109 | 147861447 | 147867311 | 5,864 | loss | 1740 | HTR4 | N | 0 | 6 | 8.91 | Intron+ve, ASD > 4, Normals < 2, no Sanger filter applied |
| 5 | 109 | 147861447 | 147867311 | 5,864 | loss | 1742 | HTR4 | N | 0 | 6 | 8.91 | Intron+ve, ASD > 4, Normals < 2, no Sanger filter applied |
| 5 | 110 | 150204135 | 150207307 | 3,172 | loss | 1405 | IRGM | Y | 1 | 3 | 4.44 | Exon+ve, 5 > ASD > 1, Normals < 2, Sanger-ve |
| 5 | 110 | 150204135 | 150207307 | 3,172 | loss | 1696 | IRGM | Y | 1 | 3 | 4.44 | Exon+ve, 5 > ASD > 1, Normals < 2, Sanger-ve |
| 5 | 110 | 150204135 | 150207307 | 3,172 | loss | 1831 | IRGM | Y | 1 | 3 | 4.44 | Exon+ve, 5 > ASD > 1, Normals < 2, Sanger-ve |
| 5 | 111 | 180194323 | 180342859 | 148,536 | loss | 1229 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | gain | 1253 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | gain | 1316 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | gain | 1426 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1429 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | gain | 1441 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | gain | 1442 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | gain | 1495 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | gain | 1496 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | gain | 1502 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | gain | 1504 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | gain | 1517 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1532 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1546 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1548 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1580 | BTNL8, LOC729678, ZFP62 | Y | 0 | 32 | 49.43 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 5 | 111 | 180194323 | 180342859 | 148,536 | loss | 1606 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1612 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1634 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1641 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | gain | 1648 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1686 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1696 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1792 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1805 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1851 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1861 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1897 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1902 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 1927 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | gain | 1997 | BTNL8, LOC729678, ZFP62 | Y | 0 | 32 | 49.43 | Exon+ve, ASD > 4, Normals < 2, no Sanger filter applied |
| 5 | 111 | 180194323 | 180342859 | 148,536 | loss | 2035 | BTNL8, LOC729678, ZFP62 | Y | 0 | 32 | 49.43 | Exon+ve, ASD > 4, Normals < 2, no Sanger filter applied |
| 6 | 112 | 26811016 | 26849721 | 38,705 | loss | 1224 | | N | 0 | 24 | 36.62 | high OR intergenic (OR > 30) |
| 6 | 112 | 26811016 | 26849721 | 38,705 | loss | 1252 | | N | 0 | 24 | 36.62 | high OR intergenic (OR > 30) |
| 6 | 112 | 26811016 | 26849721 | 38,705 | loss | 1273 | | N | 0 | 24 | 36.62 | high OR intergenic (OR > 30) |
| 6 | 112 | 26811016 | 26849721 | 38,705 | loss | 1286 | | N | 0 | 24 | 36.62 | high OR intergenic (OR > 30) |
| 6 | 112 | 26811016 | 26849721 | 38,705 | loss | 1293 | | N | 0 | 24 | 36.62 | high OR intergenic (OR > 30) |
| 6 | 112 | 26811016 | 26849721 | 38,705 | loss | 1307 | | N | 0 | 24 | 36.62 | high OR intergenic (OR > 30) |
| 6 | 112 | 26811016 | 26849721 | 38,705 | loss | 1411 | | N | 0 | 24 | 36.62 | high OR intergenic (OR > 30) |
| 6 | 112 | 26811016 | 26849721 | 38,705 | loss | 1419 | | N | 0 | 24 | 36.62 | high OR intergenic (OR > 30) |
| 6 | 112 | 26811016 | 26849721 | 38,705 | gain | 1475 | | N | 0 | 24 | 36.62 | high OR intergenic (OR > 30) |
| 6 | 112 | 26811016 | 26849721 | 38,705 | gain | 1485 | | N | 0 | 24 | 36.62 | high OR intergenic (OR > 30) |
| 6 | 112 | 26811016 | 26849721 | 38,705 | gain | 1525 | | N | 0 | 24 | 36.62 | high OR intergenic (OR > 30) |
| 6 | 112 | 26811016 | 26849721 | 38,705 | gain | 1538 | | N | 0 | 24 | 36.62 | high OR intergenic (OR > 30) |
| 6 | 112 | 26811016 | 26849721 | 38,705 | loss | 1572 | | N | 0 | 24 | 36.62 | high OR intergenic (OR > 30) |
| 6 | 112 | 26811016 | 26849721 | 38,705 | gain | 1599 | | N | 0 | 24 | 36.62 | high OR intergenic (OR > 30) |
| 6 | 112 | 26811016 | 26849721 | 38,705 | loss | 1602 | | N | 0 | 24 | 36.62 | high OR intergenic (OR > 30) |
| 6 | 112 | 26811016 | 26849721 | 38,705 | loss | 1615 | | N | 0 | 24 | 36.62 | high OR intergenic (OR > 30) |
| 6 | 112 | 26811016 | 26849721 | 38,705 | gain | 1628 | | N | 0 | 24 | 36.62 | high OR intergenic (OR > 30) |
| 6 | 112 | 26811016 | 26849721 | 38,705 | loss | 1629 | | N | 0 | 24 | 36.62 | high OR intergenic (OR > 30) |
| 6 | 112 | 26811016 | 26849721 | 38,705 | gain | 1773 | | N | 0 | 24 | 36.62 | high OR intergenic (OR > 30) |
| 6 | 112 | 26811016 | 26849721 | 38,705 | loss | 1807 | | N | 0 | 24 | 36.62 | high OR intergenic (OR > 30) |
| 6 | 112 | 26811016 | 26849721 | 38,705 | loss | 1899 | | N | 0 | 24 | 36.62 | high OR intergenic (OR > 30) |
| 6 | 112 | 26811016 | 26849721 | 38,705 | loss | 1929 | | N | 0 | 24 | 36.62 | high OR intergenic (OR > 30) |
| 6 | 112 | 26811016 | 26849721 | 38,705 | loss | 1931 | | N | 0 | 24 | 36.62 | high OR intergenic (OR > 30) |
| 6 | 112 | 26811016 | 26849721 | 38,705 | gain | 2041 | | N | 0 | 24 | 36.62 | high OR intergenic (OR > 30) |
| 6 | 113 | 31109597 | 31114029 | 4,432 | loss | 1662 | PBMUCL1 | Y | 1 | 2 | 2.95 | Exon+ve, 5 > ASD > 1, Normals < 2, Sanger-ve |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 6 | 113 | 31109597 | 31114029 | 4,432 | loss | 1849 | PBMUCL1 | Y | 1 | 2 | 2.95 | Exon+ve, 5 > ASD > 1, Normals < 2, Sanger-ve |
| 6 | 114 | 33504620 | 33505974 | 1,354 | loss | 1297 | SYNGAP1 | N | 0 | 8 | 11.92 | Intron+ve, ASD > 4, Normals < 2, no Sanger filter applied |
| 6 | 114 | 33504620 | 33505974 | 1,354 | loss | 1824 | SYNGAP1 | N | 0 | 8 | 11.92 | Intron+ve, ASD > 4, Normals < 2, no Sanger filter applied |
| 6 | 114 | 33504620 | 33505974 | 1,354 | loss | 1840 | SYNGAP1 | N | 0 | 8 | 11.92 | Intron+ve, ASD > 4, Normals < 2, no Sanger filter applied |
| 6 | 114 | 33504620 | 33505974 | 1,354 | loss | 1841 | SYNGAP1 | N | 0 | 8 | 11.92 | Intron+ve, ASD > 4, Normals < 2, no Sanger filter applied |
| 6 | 114 | 33504620 | 33505974 | 1,354 | loss | 1872 | SYNGAP1 | N | 0 | 8 | 11.92 | Intron+ve, ASD > 4, Normals < 2, no Sanger filter applied |
| 6 | 114 | 33504620 | 33505974 | 1,354 | loss | 1905 | SYNGAP1 | N | 0 | 8 | 11.92 | Intron+ve, ASD > 4, Normals < 2, no Sanger filter applied |
| 6 | 114 | 33504620 | 33505974 | 1,354 | loss | 1967 | SYNGAP1 | N | 0 | 8 | 11.92 | Intron+ve, ASD > 4, Normals < 2, no Sanger filter applied |
| 6 | 114 | 33504620 | 33505974 | 1,354 | loss | 2031 | SYNGAP1 | N | 0 | 8 | 11.92 | Intron+ve, ASD > 4, Normals < 2, no Sanger filter applied |
| 6 | 115 | 35856922 | 35862501 | 5,579 | loss | 1301 | C6orf127 | Y | 0 | 23 | 35.04 | Exon+ve, ASD > 4, Normals < 2, no Sanger filter applied |
| 6 | 115 | 35856922 | 35862501 | 5,579 | gain | 1347 | C6orf127 | Y | 0 | 23 | 35.04 | Exon+ve, ASD > 4, Normals < 2, no Sanger filter applied |
| 6 | 115 | 35856922 | 35862501 | 5,579 | gain | 1348 | C6orf127 | Y | 0 | 23 | 35.04 | Exon+ve, ASD > 4, Normals < 2, no Sanger filter applied |
| 6 | 115 | 35856922 | 35862501 | 5,579 | gain | 1530 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1680 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1694 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1718 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1837 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1839 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1852 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1917 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1940 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1946 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1950 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1952 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1958 | C6orf127 | Y | 0 | 23 | 35.04 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 6 | 115 | 35856922 | 35862501 | 5,579 | loss | 1959 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1961 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1962 | C6orf127 | Y | 0 | 23 | 35.04 | Exon+ve, ASD > 4, Normals < 2, no Sanger filter applied |
| 6 | 115 | 35856922 | 35862501 | 5,579 | loss | 1965 | C6orf127 | Y | 0 | 23 | 35.04 | Exon+ve, ASD > 4, Normals < 2, no Sanger filter applied |
| 6 | 115 | 35856922 | 35862501 | 5,579 | loss | 2005 | C6orf127 | Y | 0 | 23 | 35.04 | Exon+ve, ASD > 4, Normals < 2, no Sanger filter applied |
| 6 | 115 | 35856922 | 35862501 | 5,579 | loss | 2006 | C6orf127 | Y | 0 | 23 | 35.04 | Exon+ve, ASD > 4, Normals < 2, no Sanger filter applied |
| 6 | 115 | 35856922 | 35862501 | 5,579 | loss | 2018 | C6orf127 | Y | 0 | 23 | 35.04 | Exon+ve, ASD > 4, Normals < 2, no Sanger filter applied |
| 6 | 116 | 35862503 | 35864635 | 2,132 | loss | 1301 | C6orf127 | Y | 0 | 25 | 38.2 | Exon+ve, ASD > 4, Normals < 2, no Sanger filter applied |
| 6 | 116 | 35862503 | 35864635 | 2,132 | gain | 1347 | C6orf127 | Y | 0 | 25 | 38.2 | Exon+ve, ASD > 4, Normals < 2, no Sanger filter applied |
| 6 | 116 | 35862503 | 35864635 | 2,132 | gain | 1348 | C6orf127 | Y | 0 | 25 | 38.2 | Exon+ve, ASD > 4, Normals < 2, no Sanger filter applied |
| 6 | 116 | 35862503 | 35864635 | 2,132 | gain | 1414 | C6orf127 | Y | 0 | 25 | 38.2 | Exon+ve, ASD > 4, Normals < 2, no Sanger filter applied |
| 6 | 116 | 35862503 | 35864635 | 2,132 | gain | 1530 | C6orf127 | Y | 0 | 25 | 38.2 | Exon+ve, ASD > 4, Normals < 2, no Sanger filter applied |
| 6 | 116 | 35862503 | 35864635 | 2,132 | loss | 1680 | C6orf127 | Y | 0 | 25 | 38.2 | Exon+ve, ASD > 4, Normals < 2, no Sanger filter applied |
| 6 | 116 | 35862503 | 35864635 | 2,132 | loss | 1694 | C6orf127 | Y | 0 | 25 | 38.2 | Exon+ve, ASD > 4, Normals < 2, no Sanger filter applied |
| 6 | 116 | 35862503 | 35864635 | 2,132 | gain | 1710 | C6orf127 | Y | 0 | 25 | 38.2 | Exon+ve, ASD > 4, Normals < 2, no Sanger filter applied |
| 6 | 116 | 35862503 | 35864635 | 2,132 | loss | 1718 | C6orf127 | Y | 0 | 25 | 38.2 | Exon+ve, ASD > 4, Normals < 2, no Sanger filter applied |
| 6 | 116 | 35862503 | 35864635 | 2,132 | gain | 1760 | C6orf127 | Y | 0 | 25 | 38.2 | Exon+ve, ASD > 4, Normals < 2, no Sanger filter applied |
| 6 | 116 | 35862503 | 35864635 | 2,132 | loss | 1837 | C6orf127 | Y | 0 | 25 | 38.2 | Exon+ve, ASD > 4, Normals < 2, no Sanger filter applied |
| 6 | 116 | 35862503 | 35864635 | 2,132 | loss | 1839 | C6orf127 | Y | 0 | 25 | 38.2 | Exon+ve, ASD > 4, Normals < 2, no Sanger filter applied |
| 6 | 116 | 35862503 | 35864635 | 2,132 | loss | 1852 | C6orf127 | Y | 0 | 25 | 38.2 | Exon+ve, ASD > 4, Normals < 2, no Sanger filter applied |
| 6 | 116 | 35862503 | 35864635 | 2,132 | loss | 1917 | C6orf127 | Y | 0 | 25 | 38.2 | Exon+ve, ASD > 4, Normals < 2, no Sanger filter applied |
| 6 | 116 | 35862503 | 35864635 | 2,132 | loss | 1946 | C6orf127 | Y | 0 | 25 | 38.2 | Exon+ve, ASD > 4, Normals < 2, no Sanger filter applied |
| 6 | 116 | 35862503 | 35864635 | 2,132 | loss | 1950 | C6orf127 | Y | 0 | 25 | 38.2 | Exon+ve, ASD > 4, Normals < 2, no Sanger filter applied |
| 6 | 116 | 35862503 | 35864635 | 2,132 | loss | 1952 | C6orf127 | Y | 0 | 25 | 38.2 | Exon+ve, ASD > 4, Normals < 2, no Sanger filter applied |
| 6 | 116 | 35862503 | 35864635 | 2,132 | loss | 1958 | C6orf127 | Y | 0 | 25 | 38.2 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 6 | 116 | 35862503 | 35864635 | 2,132 | loss | 1959 | C6orf127 | Y | 0 | 25 | 38.2 | Exon+ve, ASD > 4, Normals < 2, no Sanger filter applied |
| 6 | 116 | 35862503 | 35864635 | 2,132 | loss | 1961 | C6orf127 | Y | 0 | 25 | 38.2 | Exon+ve, ASD > 4, Normals < 2, no Sanger filter applied |
| 6 | 116 | 35862503 | 35864635 | 2,132 | loss | 1962 | C6orf127 | Y | 0 | 25 | 38.2 | Exon+ve, ASD > 4, Normals < 2, no Sanger filter applied |
| 6 | 116 | 35862503 | 35864635 | 2,132 | loss | 1965 | C6orf127 | Y | 0 | 25 | 38.2 | Exon+ve, ASD > 4, Normals < 2, no Sanger filter applied |
| 6 | 116 | 35862503 | 35864635 | 2,132 | loss | 2005 | C6orf127 | Y | 0 | 25 | 38.2 | Exon+ve, ASD > 4, Normals < 2, no Sanger filter applied |
| 6 | 116 | 35862503 | 35864635 | 2,132 | loss | 2006 | C6orf127 | Y | 0 | 25 | 38.2 | Exon+ve, ASD > 4, Normals < 2, no Sanger filter applied |
| 6 | 116 | 35862503 | 35864635 | 2,132 | loss | 2018 | C6orf127 | Y | 0 | 25 | 38.2 | Exon+ve, ASD > 4, Normals < 2, no Sanger filter applied |
| 6 | 117 | 79018960 | 79024556 | 5,596 | gain | 1220 | | N | 0 | 25 | 38.2 | high OR intergenic (OR > 30) |
| 6 | 117 | 79018960 | 79024556 | 5,596 | gain | 1241 | | N | 0 | 25 | 38.2 | high OR intergenic (OR > 30) |
| 6 | 117 | 79018960 | 79024556 | 5,596 | gain | 1274 | | N | 0 | 25 | 38.2 | high OR intergenic (OR > 30) |
| 6 | 117 | 79018960 | 79024556 | 5,596 | gain | 1279 | | N | 0 | 25 | 38.2 | high OR intergenic (OR > 30) |
| 6 | 117 | 79018960 | 79024556 | 5,596 | gain | 1446 | | N | 0 | 25 | 38.2 | high OR intergenic (OR > 30) |
| 6 | 117 | 79018960 | 79024556 | 5,596 | loss | 1449 | | N | 0 | 25 | 38.2 | high OR intergenic (OR > 30) |
| 6 | 117 | 79018960 | 79024556 | 5,596 | gain | 1496 | | N | 0 | 25 | 38.2 | high OR intergenic (OR > 30) |
| 6 | 117 | 79018960 | 79024556 | 5,596 | loss | 1502 | | N | 0 | 25 | 38.2 | high OR intergenic (OR > 30) |
| 6 | 117 | 79018960 | 79024556 | 5,596 | loss | 1534 | | N | 0 | 25 | 38.2 | high OR intergenic (OR > 30) |
| 6 | 117 | 79018960 | 79024556 | 5,596 | gain | 1555 | | N | 0 | 25 | 38.2 | high OR intergenic (OR > 30) |
| 6 | 117 | 79018960 | 79024556 | 5,596 | gain | 1662 | | N | 0 | 25 | 38.2 | high OR intergenic (OR > 30) |
| 6 | 117 | 79018960 | 79024556 | 5,596 | gain | 1687 | | N | 0 | 25 | 38.2 | high OR intergenic (OR > 30) |
| 6 | 117 | 79018960 | 79024556 | 5,596 | gain | 1689 | | N | 0 | 25 | 38.2 | high OR intergenic (OR > 30) |
| 6 | 117 | 79018960 | 79024556 | 5,596 | gain | 1698 | | N | 0 | 25 | 38.2 | high OR intergenic (OR > 30) |
| 6 | 117 | 79018960 | 79024556 | 5,596 | gain | 1712 | | N | 0 | 25 | 38.2 | high OR intergenic (OR > 30) |
| 6 | 117 | 79018960 | 79024556 | 5,596 | gain | 1722 | | N | 0 | 25 | 38.2 | high OR intergenic (OR > 30) |
| 6 | 117 | 79018960 | 79024556 | 5,596 | gain | 1744 | | N | 0 | 25 | 38.2 | high OR intergenic (OR > 30) |
| 6 | 117 | 79018960 | 79024556 | 5,596 | gain | 1757 | | N | 0 | 25 | 38.2 | high OR intergenic (OR > 30) |
| 6 | 117 | 79018960 | 79024556 | 5,596 | gain | 1774 | | N | 0 | 25 | 38.2 | high OR intergenic (OR > 30) |
| 6 | 117 | 79018960 | 79024556 | 5,596 | gain | 1817 | | N | 0 | 25 | 38.2 | high OR intergenic (OR > 30) |
| 6 | 117 | 79018960 | 79024556 | 5,596 | gain | 1959 | | N | 0 | 25 | 38.2 | high OR intergenic (OR > 30) |
| 6 | 117 | 79018960 | 79024556 | 5,596 | gain | 1965 | | N | 0 | 25 | 38.2 | high OR intergenic (OR > 30) |
| 6 | 117 | 79018960 | 79024556 | 5,596 | gain | 2037 | | N | 0 | 25 | 38.2 | high OR intergenic (OR > 30) |
| 6 | 117 | 79018960 | 79024556 | 5,596 | gain | 2043 | | N | 0 | 25 | 38.2 | high OR intergenic (OR > 30) |
| 6 | 117 | 79018960 | 79024556 | 5,596 | gain | 2045 | | N | 0 | 25 | 38.2 | high OR intergenic (OR > 30) |
| 6 | 118 | 81099147 | 81100756 | 1,609 | loss | 1552 | BCKDHB | N | 1 | 5 | 7.42 | Intron+ve, ASD > 4, Normals < 2, no Sanger filter applied |
| 6 | 118 | 81099147 | 81100756 | 1,609 | gain | 1621 | BCKDHB | N | 1 | 5 | 7.42 | Intron+ve, ASD > 4, Normals < 2, no Sanger filter applied |
| 6 | 118 | 81099147 | 81100756 | 1,609 | gain | 1707 | BCKDHB | N | 1 | 5 | 7.42 | Intron+ve, ASD > 4, Normals < 2, no Sanger filter applied |
| 6 | 118 | 81099147 | 81100756 | 1,609 | gain | 1753 | BCKDHB | N | 1 | 5 | 7.42 | Intron+ve, ASD > 4, Normals < 2, no Sanger filter applied |
| 6 | 118 | 81099147 | 81100756 | 1,609 | gain | 1773 | BCKDHB | N | 1 | 5 | 7.42 | Intron+ve, ASD > 4, Normals < 2, no Sanger filter applied |
| 6 | 119 | 88089542 | 88096147 | 6,605 | loss | 1943 | C6orf162, GJB7 | Y | 1 | 4 | 5.92 | Exon+ve, 5 > ASD > 1, Normals < 2, Sanger-ve |
| 6 | 119 | 88089542 | 88096147 | 6,605 | loss | 1951 | C6orf162, GJB7 | Y | 1 | 4 | 5.92 | Exon+ve, 5 > ASD > 1, Normals < 2, Sanger-ve |
| 6 | 119 | 88089542 | 88096147 | 6,605 | loss | 1964 | C6orf162, GJB7 | Y | 1 | 4 | 5.92 | Exon+ve, 5 > ASD > 1, Normals < 2, Sanger-ve |
| 6 | 119 | 88089542 | 88096147 | 6,605 | loss | 2034 | C6orf162, GJB7 | Y | 1 | 4 | 5.92 | Exon+ve, 5 > ASD > 1, Normals < 2, Sanger-ve |
| 6 | 120 | 88899057 | 88923379 | 24,322 | gain | 1662 | CNR1 | Y | 1 | 3 | 4.44 | Exon+ve, 5 > ASD > 1, Normals < 2, Sanger-ve |
| 6 | 120 | 88899057 | 88923379 | 24,322 | gain | 1735 | CNR1 | Y | 1 | 3 | 4.44 | Exon+ve, 5 > ASD > 1, Normals < 2, Sanger-ve |
| 6 | 120 | 88899057 | 88923379 | 24,322 | gain | 1899 | CNR1 | Y | 1 | 3 | 4.44 | Exon+ve, 5 > ASD > 1, Normals < 2, Sanger-ve |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 6 | 121 | 107108807 | 107111183 | 2,376 | gain | 1402 | AIM1 | Y | 1 | 3 | 4.44 | Exon+ve, 5 > ASD > 1, Normals < 2, Sanger-ve |
| 6 | 121 | 107108807 | 107111183 | 2,376 | gain | 1527 | AIM1 | Y | 1 | 3 | 4.44 | Exon+ve, 5 > ASD > 1, Normals < 2, Sanger-ve |
| 6 | 121 | 107108807 | 107111183 | 2,376 | gain | 1710 | AIM1 | Y | 1 | 3 | 4.44 | Exon+ve, 5 > ASD > 1, Normals < 2, Sanger-ve |
| 6 | 122 | 118844331 | 118956714 | 112,383 | gain | 1511 | C6orf204, BRD7P3 | Y | 1 | 3 | 4.44 | Exon+ve, 5 > ASD > 1, Normals < 2, Sanger-ve |
| 6 | 122 | 118844331 | 118956714 | 112,383 | gain | 1710 | C6orf204, BRD7P3 | Y | 1 | 3 | 4.44 | Exon+ve, 5 > ASD > 1, Normals < 2, Sanger-ve |
| 6 | 122 | 118844331 | 118956714 | 112,383 | gain | 1759 | C6orf204, BRD7P3 | Y | 1 | 3 | 4.44 | Exon+ve, 5 > ASD > 1, Normals < 2, Sanger-ve |
| 6 | 123 | 118956715 | 118958026 | 1,311 | gain | 1511 | C6orf204 | N | 1 | 5 | 7.42 | Intron+ve, ASD > 4, Normals < 2, no Sanger filter applied |
| 6 | 123 | 118956715 | 118958026 | 1,311 | loss | 1565 | C6orf204 | N | 1 | 5 | 7.42 | Intron+ve, ASD > 4, Normals < 2, no Sanger filter applied |
| 6 | 123 | 118956715 | 118958026 | 1,311 | loss | 1590 | C6orf204 | N | 1 | 5 | 7.42 | Intron+ve, ASD > 4, Normals < 2, no Sanger filter applied |
| 6 | 123 | 118956715 | 118958026 | 1,311 | gain | 1710 | C6orf204 | N | 1 | 5 | 7.42 | Intron+ve, ASD > 4, Normals < 2, no Sanger filter applied |
| 6 | 123 | 118956715 | 118958026 | 1,311 | gain | 1759 | C6orf204 | N | 1 | 5 | 7.42 | Intron+ve, ASD > 4, Normals < 2, no Sanger filter applied |
| 6 | 124 | 118969194 | 119007311 | 38,117 | gain | 1511 | C6orf204, PLN | Y | 1 | 2 | 2.95 | Exon+ve, 5 > ASD > 1, Normals < 2, Sanger-ve |
| 6 | 124 | 118969194 | 119007311 | 38,117 | gain | 1710 | C6orf204, PLN | Y | 1 | 2 | 2.95 | Exon+ve, 5 > ASD > 1, Normals < 2, Sanger-ve |
| 6 | 125 | 119007312 | 119113493 | 106,181 | gain | 1511 | C6orf204 | Y | 1 | 3 | 4.44 | Exon+ve, 5 > ASD > 1, Normals < 2, Sanger-ve |
| 6 | 125 | 119007312 | 119113493 | 106,181 | gain | 1710 | C6orf204 | Y | 1 | 3 | 4.44 | Exon+ve, 5 > ASD > 1, Normals < 2, Sanger-ve |
| 6 | 125 | 119007312 | 119113493 | 106,181 | gain | 1777 | C6orf204 | Y | 1 | 3 | 4.44 | Exon+ve, 5 > ASD > 1, Normals < 2, Sanger-ve |
| 6 | 126 | 124469271 | 124478060 | 8,789 | gain | 1244 | NKAIN2 | N | 1 | 6 | 8.91 | Intron+ve, ASD > 4, Normals < 2, no Sanger filter applied |
| 6 | 126 | 124469271 | 124478060 | 8,789 | gain | 1247 | NKAIN2 | N | 1 | 6 | 8.91 | Intron+ve, ASD > 4, Normals < 2, no Sanger filter applied |
| 6 | 126 | 124469271 | 124478060 | 8,789 | gain | 1277 | NKAIN2 | N | 1 | 6 | 8.91 | Intron+ve, ASD > 4, Normals < 2, no Sanger filter applied |
| 6 | 126 | 124469271 | 124478060 | 8,789 | gain | 1450 | NKAIN2 | N | 1 | 6 | 8.91 | Intron+ve, ASD > 4, Normals < 2, no Sanger filter applied |
| 6 | 126 | 124469271 | 124478060 | 8,789 | gain | 1610 | NKAIN2 | N | 1 | 6 | 8.91 | Intron+ve, ASD > 4, Normals < 2, no Sanger filter applied |
| 6 | 126 | 124469271 | 124478060 | 8,789 | gain | 1880 | NKAIN2 | N | 1 | 6 | 8.91 | Intron+ve, ASD > 4, Normals < 2, no Sanger filter applied |
| 6 | 127 | 132748175 | 132749308 | 1,133 | loss | 1389 | MOXD1 | N | 0 | 7 | 10.41 | Intron+ve, ASD > 4, Normals < 2, no Sanger filter applied |
| 6 | 127 | 132748175 | 132749308 | 1,133 | loss | 1540 | MOXD1 | N | 0 | 7 | 10.41 | Intron+ve, ASD > 4, Normals < 2, no Sanger filter applied |
| 6 | 127 | 132748175 | 132749308 | 1,133 | loss | 1605 | MOXD1 | N | 0 | 7 | 10.41 | Intron+ve, ASD > 4, Normals < 2, no Sanger filter applied |
| 6 | 127 | 132748175 | 132749308 | 1,133 | loss | 1657 | MOXD1 | N | 0 | 7 | 10.41 | Intron+ve, ASD > 4, Normals < 2, no Sanger filter applied |
| 6 | 127 | 132748175 | 132749308 | 1,133 | loss | 1729 | MOXD1 | N | 0 | 7 | 10.41 | Intron+ve, ASD > 4, Normals < 2, no Sanger filter applied |
| 6 | 127 | 132748175 | 132749308 | 1,133 | loss | 1738 | MOXD1 | N | 0 | 7 | 10.41 | Intron+ve, ASD > 4, Normals < 2, no Sanger filter applied |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 6 | 127 | 132748175 | 132749308 | 1,133 | loss | 1743 | MOXD1 | N | 0 | 7 | 10.41 | Intron+ve, ASD > 4, Normals < 2, no Sanger filter applied |
| 6 | 128 | 134627341 | 134631700 | 4,359 | loss | 1224 | SGK1 | N | 0 | 5 | 7.42 | Intron+ve, ASD > 4, Normals < 2, no Sanger filter applied |
| 6 | 128 | 134627341 | 134631700 | 4,359 | loss | 1576 | SGK1 | N | 0 | 5 | 7.42 | Intron+ve, ASD > 4, Normals < 2, no Sanger filter applied |
| 6 | 128 | 134627341 | 134631700 | 4,359 | loss | 1665 | SGK1 | N | 0 | 5 | 7.42 | Intron+ve, ASD > 4, Normals < 2, no Sanger filter applied |
| 6 | 128 | 134627341 | 134631700 | 4,359 | loss | 1667 | SGK1 | N | 0 | 5 | 7.42 | Intron+ve, ASD > 4, Normals < 2, no Sanger filter applied |
| 6 | 128 | 134627341 | 134631700 | 4,359 | loss | 1708 | SGK1 | N | 0 | 5 | 7.42 | Intron+ve, ASD > 4, Normals < 2, no Sanger filter applied |
| 6 | 129 | 139641158 | 139643728 | 2,570 | loss | 1372 | TXLNB | N | 0 | 13 | 19.51 | Intron+ve, ASD > 4, Normals < 2, no Sanger filter applied |
| 6 | 129 | 139641158 | 139643728 | 2,570 | loss | 1387 | TXLNB | N | 0 | 13 | 19.51 | Intron+ve, ASD > 4, Normals < 2, no Sanger filter applied |
| 6 | 129 | 139641158 | 139643728 | 2,570 | loss | 1396 | TXLNB | N | 0 | 13 | 19.51 | Intron+ve, ASD > 4, Normals < 2, no Sanger filter applied |
| 6 | 129 | 139641158 | 139643728 | 2,570 | loss | 1401 | TXLNB | N | 0 | 13 | 19.51 | Intron+ve, ASD > 4, Normals < 2, no Sanger filter applied |
| 6 | 129 | 139641158 | 139643728 | 2,570 | loss | 1403 | TXLNB | N | 0 | 13 | 19.51 | Intron+ve, ASD > 4, Normals < 2, no Sanger filter applied |
| 6 | 129 | 139641158 | 139643728 | 2,570 | loss | 1432 | TXLNB | N | 0 | 13 | 19.51 | Intron+ve, ASD > 4, Normals < 2, no Sanger filter applied |
| 6 | 129 | 139641158 | 139643728 | 2,570 | loss | 1572 | TXLNB | N | 0 | 13 | 19.51 | Intron+ve, ASD > 4, Normals < 2, no Sanger filter applied |
| 6 | 129 | 139641158 | 139643728 | 2,570 | loss | 1616 | TXLNB | N | 0 | 13 | 19.51 | Intron+ve, ASD > 4, Normals < 2, no Sanger filter applied |
| 6 | 129 | 139641158 | 139643728 | 2,570 | loss | 1696 | TXLNB | N | 0 | 13 | 19.51 | Intron+ve, ASD > 4, Normals < 2, no Sanger filter applied |
| 6 | 129 | 139641158 | 139643728 | 2,570 | loss | 1864 | TXLNB | N | 0 | 13 | 19.51 | Intron+ve, ASD > 4, Normals < 2, no Sanger filter applied |
| 6 | 129 | 139641158 | 139643728 | 2,570 | loss | 1895 | TXLNB | N | 0 | 13 | 19.51 | Intron+ve, ASD > 4, Normals < 2, no Sanger filter applied |
| 6 | 129 | 139641158 | 139643728 | 2,570 | loss | 2040 | TXLNB | N | 0 | 13 | 19.51 | Intron+ve, ASD > 4, Normals < 2, no Sanger filter applied |
| 6 | 129 | 139641158 | 139643728 | 2,570 | loss | 2042 | TXLNB | N | 0 | 13 | 19.51 | Intron+ve, ASD > 4, Normals < 2, no Sanger filter applied |
| 6 | 130 | 139643729 | 139645416 | 1,687 | loss | 1230 | TXLNB | N | 0 | 24 | 36.62 | Intron+ve, ASD > 4, Normals < 2, no Sanger filter applied |
| 6 | 130 | 139643729 | 139645416 | 1,687 | loss | 1372 | TXLNB | N | 0 | 24 | 36.62 | Intron+ve, ASD > 4, Normals < 2, no Sanger filter applied |
| 6 | 130 | 139643729 | 139645416 | 1,687 | loss | 1387 | TXLNB | N | 0 | 24 | 36.62 | Intron+ve, ASD > 4, Normals < 2, no Sanger filter applied |
| 6 | 130 | 139643729 | 139645416 | 1,687 | loss | 1396 | TXLNB | N | 0 | 24 | 36.62 | Intron+ve, ASD > 4, Normals < 2, no Sanger filter applied |
| 6 | 130 | 139643729 | 139645416 | 1,687 | loss | 1401 | TXLNB | N | 0 | 24 | 36.62 | Intron+ve, ASD > 4, Normals < 2, no Sanger filter applied |
| 6 | 130 | 139643729 | 139645416 | 1,687 | loss | 1403 | TXLNB | N | 0 | 24 | 36.62 | Intron+ve, ASD > 4, Normals < 2, no Sanger filter applied |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 6 | 130 | 139643729 | 139645416 | 1,687 | loss | 1428 | TXLNB | N | 0 | 24 | 36.62 | Intron+ve, ASD > 4, Normals < 2, no Sanger filter applied |
| 6 | 130 | 139643729 | 139645416 | 1,687 | loss | 1432 | TXLNB | N | 0 | 24 | 36.62 | Intron+ve, ASD > 4, Normals < 2, no Sanger filter applied |
| 6 | 130 | 139643729 | 139645416 | 1,687 | loss | 1551 | TXLNB | N | 0 | 24 | 36.62 | Intron+ve, ASD > 4, Normals < 2, no Sanger filter applied |
| 6 | 130 | 139643729 | 139645416 | 1,687 | loss | 1572 | TXLNB | N | 0 | 24 | 36.62 | Intron+ve, ASD > 4, Normals < 2, no Sanger filter applied |
| 6 | 130 | 139643729 | 139645416 | 1,687 | loss | 1577 | TXLNB | N | 0 | 24 | 36.62 | Intron+ve, ASD > 4, Normals < 2, no Sanger filter applied |
| 6 | 130 | 139643729 | 139645416 | 1,687 | loss | 1616 | TXLNB | N | 0 | 24 | 36.62 | Intron+ve, ASD > 4, Normals < 2, no Sanger filter applied |
| 6 | 130 | 139643729 | 139645416 | 1,687 | loss | 1696 | TXLNB | N | 0 | 24 | 36.62 | Intron+ve, ASD > 4, Normals < 2, no Sanger filter applied |
| 6 | 130 | 139643729 | 139645416 | 1,687 | loss | 1811 | TXLNB | N | 0 | 24 | 36.62 | Intron+ve, ASD > 4, Normals < 2, no Sanger filter applied |
| 6 | 130 | 139643729 | 139645416 | 1,687 | loss | 1837 | TXLNB | N | 0 | 24 | 36.62 | Intron+ve, ASD > 4, Normals < 2, no Sanger filter applied |
| 6 | 130 | 139643729 | 139645416 | 1,687 | loss | 1859 | TXLNB | N | 0 | 24 | 36.62 | Intron+ve, ASD > 4, Normals < 2, no Sanger filter applied |
| 6 | 130 | 139643729 | 139645416 | 1,687 | loss | 1864 | TXLNB | N | 0 | 24 | 36.62 | Intron+ve, ASD > 4, Normals < 2, no Sanger filter applied |
| 6 | 130 | 139643729 | 139645416 | 1,687 | loss | 1895 | TXLNB | N | 0 | 24 | 36.62 | Intron+ve, ASD > 4, Normals < 2, no Sanger filter applied |
| 6 | 130 | 139643729 | 139645416 | 1,687 | loss | 1896 | TXLNB | N | 0 | 24 | 36.62 | Intron+ve, ASD > 4, Normals < 2, no Sanger filter applied |
| 6 | 130 | 139643729 | 139645416 | 1,687 | loss | 1898 | TXLNB | N | 0 | 24 | 36.62 | Intron+ve, ASD > 4, Normals < 2, no Sanger filter applied |
| 6 | 130 | 139643729 | 139645416 | 1,687 | loss | 1946 | TXLNB | N | 0 | 24 | 36.62 | Intron+ve, ASD > 4, Normals < 2, no Sanger filter applied |
| 6 | 130 | 139643729 | 139645416 | 1,687 | loss | 2040 | TXLNB | N | 0 | 24 | 36.62 | Intron+ve, ASD > 4, Normals < 2, no Sanger filter applied |
| 6 | 130 | 139643729 | 139645416 | 1,687 | loss | 2042 | TXLNB | N | 0 | 24 | 36.62 | Intron+ve, ASD > 4, Normals < 2, no Sanger filter applied |
| 6 | 130 | 139643729 | 139645416 | 1,687 | loss | 2044 | TXLNB | N | 0 | 24 | 36.62 | Intron+ve, ASD > 4, Normals < 2, no Sanger filter applied |
| 6 | 131 | 152772611 | 152776554 | 3,943 | loss | 1403 | SYNE1 | Y | 1 | 5 | 7.42 | Exon+ve, ASD > 4, Normals < 2, no Sanger filter applied |
| 6 | 131 | 152772611 | 152776554 | 3,943 | loss | 1476 | SYNE1 | Y | 1 | 5 | 7.42 | Exon+ve, ASD > 4, Normals < 2, no Sanger filter applied |
| 6 | 131 | 152772611 | 152776554 | 3,943 | loss | 1538 | SYNE1 | Y | 1 | 5 | 7.42 | Exon+ve, ASD > 4, Normals < 2, no Sanger filter applied |
| 6 | 131 | 152772611 | 152776554 | 3,943 | loss | 1654 | SYNE1 | Y | 1 | 5 | 7.42 | Exon+ve, ASD > 4, Normals < 2, no Sanger filter applied |
| 6 | 131 | 152772611 | 152776554 | 3,943 | loss | 1828 | SYNE1 | Y | 1 | 5 | 7.42 | Exon+ve, ASD > 4, Normals < 2, no Sanger filter applied |
| 6 | 132 | 168728054 | 168730714 | 2,660 | loss | 1477 | SMOC2 | N | 1 | 10 | 14.94 | Intron+ve, ASD > 4, Normals < 2, no Sanger filter applied |
| 6 | 132 | 168728054 | 168730714 | 2,660 | loss | 1495 | SMOC2 | N | 1 | 10 | 14.94 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 6 | 132 | 168728054 | 168730714 | 2,660 | loss | 1505 | SMOC2 | N | 1 | 10 | 14.94 | Intron+ve, ASD > 4, Normals < 2, no Sanger filter applied |
| 6 | 132 | 168728054 | 168730714 | 2,660 | loss | 1506 | SMOC2 | N | 1 | 10 | 14.94 | Intron+ve, ASD > 4, Normals < 2, no Sanger filter applied |
| 6 | 132 | 168728054 | 168730714 | 2,660 | loss | 1527 | SMOC2 | N | 1 | 10 | 14.94 | Intron+ve, ASD > 4, Normals < 2, no Sanger filter applied |
| 6 | 132 | 168728054 | 168730714 | 2,660 | loss | 1556 | SMOC2 | N | 1 | 10 | 14.94 | Intron+ve, ASD > 4, Normals < 2, no Sanger filter applied |
| 6 | 132 | 168728054 | 168730714 | 2,660 | loss | 1598 | SMOC2 | N | 1 | 10 | 14.94 | Intron+ve, ASD > 4, Normals < 2, no Sanger filter applied |
| 6 | 132 | 168728054 | 168730714 | 2,660 | loss | 1641 | SMOC2 | N | 1 | 10 | 14.94 | Intron+ve, ASD > 4, Normals < 2, no Sanger filter applied |
| 6 | 132 | 168728054 | 168730714 | 2,660 | loss | 1647 | SMOC2 | N | 1 | 10 | 14.94 | Intron+ve, ASD > 4, Normals < 2, no Sanger filter applied |
| 6 | 132 | 168728054 | 168730714 | 2,660 | loss | 1715 | SMOC2 | N | 1 | 10 | 14.94 | Intron+ve, ASD > 4, Normals < 2, no Sanger filter applied |
| 6 | 133 | 168730715 | 168734147 | 3,432 | loss | 1505 | SMOC2 | N | 0 | 7 | 10.41 | Intron+ve, ASD > 4, Normals < 2, no Sanger filter applied |
| 6 | 133 | 168730715 | 168734147 | 3,432 | loss | 1527 | SMOC2 | N | 0 | 7 | 10.41 | Intron+ve, ASD > 4, Normals < 2, no Sanger filter applied |
| 6 | 133 | 168730715 | 168734147 | 3,432 | loss | 1556 | SMOC2 | N | 0 | 7 | 10.41 | Intron+ve, ASD > 4, Normals < 2, no Sanger filter applied |
| 6 | 133 | 168730715 | 168734147 | 3,432 | loss | 1598 | SMOC2 | N | 0 | 7 | 10.41 | Intron+ve, ASD > 4, Normals < 2, no Sanger filter applied |
| 6 | 133 | 168730715 | 168734147 | 3,432 | loss | 1641 | SMOC2 | N | 0 | 7 | 10.41 | Intron+ve, ASD > 4, Normals < 2, no Sanger filter applied |
| 6 | 133 | 168730715 | 168734147 | 3,432 | loss | 1647 | SMOC2 | N | 0 | 7 | 10.41 | Intron+ve, ASD > 4, Normals < 2, no Sanger filter applied |
| 6 | 133 | 168730715 | 168734147 | 3,432 | loss | 1715 | SMOC2 | N | 0 | 7 | 10.41 | Intron+ve, ASD > 4, Normals < 2, no Sanger filter applied |
| 7 | 134 | 1037402 | 1038516 | 1,114 | loss | 1571 | C7orf50 | N | 1 | 11 | 16.46 | Intron+ve, ASD > 4, Normals < 2, no Sanger filter applied |
| 7 | 134 | 1037402 | 1038516 | 1,114 | loss | 1699 | C7orf50 | N | 1 | 11 | 16.46 | Intron+ve, ASD > 4, Normals < 2, no Sanger filter applied |
| 7 | 134 | 1037402 | 1038516 | 1,114 | loss | 1703 | C7orf50 | N | 1 | 11 | 16.46 | Intron+ve, ASD > 4, Normals < 2, no Sanger filter applied |
| 7 | 134 | 1037402 | 1038516 | 1,114 | loss | 1726 | C7orf50 | N | 1 | 11 | 16.46 | Intron+ve, ASD > 4, Normals < 2, no Sanger filter applied |
| 7 | 134 | 1037402 | 1038516 | 1,114 | loss | 1797 | C7orf50 | N | 1 | 11 | 16.46 | Intron+ve, ASD > 4, Normals < 2, no Sanger filter applied |
| 7 | 134 | 1037402 | 1038516 | 1,114 | loss | 1843 | C7orf50 | N | 1 | 11 | 16.46 | Intron+ve, ASD > 4, Normals < 2, no Sanger filter applied |
| 7 | 134 | 1037402 | 1038516 | 1,114 | loss | 1928 | C7orf50 | N | 1 | 11 | 16.46 | Intron+ve, ASD > 4, Normals < 2, no Sanger filter applied |
| 7 | 134 | 1037402 | 1038516 | 1,114 | loss | 1960 | C7orf50 | N | 1 | 11 | 16.46 | Intron+ve, ASD > 4, Normals < 2, no Sanger filter applied |
| 7 | 134 | 1037402 | 1038516 | 1,114 | loss | 1963 | C7orf50 | N | 1 | 11 | 16.46 | Intron+ve, ASD > 4, Normals < 2, no Sanger filter applied |
| 7 | 134 | 1037402 | 1038516 | 1,114 | loss | 1966 | C7orf50 | N | 1 | 11 | 16.46 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 7 | 134 | 1037402 | 1038516 | 1,114 | loss | 2032 | C7orf50 | N | 1 | 11 | 16.46 | Intron+ve, ASD > 4, Normals < 2, no Sanger filter applied |
| 7 | 135 | 1038517 | 1047635 | 9,118 | loss | 1416 | C7orf50 | N | 1 | 13 | 19.51 | Intron+ve, ASD > 4, Normals < 2, no Sanger filter applied |
| 7 | 135 | 1038517 | 1047635 | 9,118 | loss | 1498 | C7orf50 | N | 1 | 13 | 19.51 | Intron+ve, ASD > 4, Normals < 2, no Sanger filter applied |
| 7 | 135 | 1038517 | 1047635 | 9,118 | loss | 1571 | C7orf50 | N | 1 | 13 | 19.51 | Intron+ve, ASD > 4, Normals < 2, no Sanger filter applied |
| 7 | 135 | 1038517 | 1047635 | 9,118 | loss | 1699 | C7orf50 | N | 1 | 13 | 19.51 | Intron+ve, ASD > 4, Normals < 2, no Sanger filter applied |
| 7 | 135 | 1038517 | 1047635 | 9,118 | loss | 1703 | C7orf50 | N | 1 | 13 | 19.51 | Intron+ve, ASD > 4, Normals < 2, no Sanger filter applied |
| 7 | 135 | 1038517 | 1047635 | 9,118 | loss | 1726 | C7orf50 | N | 1 | 13 | 19.51 | Intron+ve, ASD > 4, Normals < 2, no Sanger filter applied |
| 7 | 135 | 1038517 | 1047635 | 9,118 | loss | 1797 | C7orf50 | N | 1 | 13 | 19.51 | Intron+ve, ASD > 4, Normals < 2, no Sanger filter applied |
| 7 | 135 | 1038517 | 1047635 | 9,118 | loss | 1843 | C7orf50 | N | 1 | 13 | 19.51 | Intron+ve, ASD > 4, Normals < 2, no Sanger filter applied |
| 7 | 135 | 1038517 | 1047635 | 9,118 | loss | 1928 | C7orf50 | N | 1 | 13 | 19.51 | Intron+ve, ASD > 4, Normals < 2, no Sanger filter applied |
| 7 | 135 | 1038517 | 1047635 | 9,118 | loss | 1960 | C7orf50 | N | 1 | 13 | 19.51 | Intron+ve, ASD > 4, Normals < 2, no Sanger filter applied |
| 7 | 135 | 1038517 | 1047635 | 9,118 | loss | 1963 | C7orf50 | N | 1 | 13 | 19.51 | Intron+ve, ASD > 4, Normals < 2, no Sanger filter applied |
| 7 | 135 | 1038517 | 1047635 | 9,118 | loss | 1966 | C7orf50 | N | 1 | 13 | 19.51 | Intron+ve, ASD > 4, Normals < 2, no Sanger filter applied |
| 7 | 135 | 1038517 | 1047635 | 9,118 | loss | 2032 | C7orf50 | N | 1 | 13 | 19.51 | Intron+ve, ASD > 4, Normals < 2, no Sanger filter applied |
| 7 | 136 | 1047636 | 1047707 | 71 | loss | 1225 | C7orf50 | N | 1 | 17 | 25.67 | Intron+ve, ASD > 4, Normals < 2, no Sanger filter applied |
| 7 | 136 | 1047636 | 1047707 | 71 | loss | 1416 | C7orf50 | N | 1 | 17 | 25.67 | Intron+ve, ASD > 4, Normals < 2, no Sanger filter applied |
| 7 | 136 | 1047636 | 1047707 | 71 | loss | 1498 | C7orf50 | N | 1 | 17 | 25.67 | Intron+ve, ASD > 4, Normals < 2, no Sanger filter applied |
| 7 | 136 | 1047636 | 1047707 | 71 | loss | 1571 | C7orf50 | N | 1 | 17 | 25.67 | Intron+ve, ASD > 4, Normals < 2, no Sanger filter applied |
| 7 | 136 | 1047636 | 1047707 | 71 | loss | 1635 | C7orf50 | N | 1 | 17 | 25.67 | Intron+ve, ASD > 4, Normals < 2, no Sanger filter applied |
| 7 | 136 | 1047636 | 1047707 | 71 | loss | 1672 | C7orf50 | N | 1 | 17 | 25.67 | Intron+ve, ASD > 4, Normals < 2, no Sanger filter applied |
| 7 | 136 | 1047636 | 1047707 | 71 | loss | 1699 | C7orf50 | N | 1 | 17 | 25.67 | Intron+ve, ASD > 4, Normals < 2, no Sanger filter applied |
| 7 | 136 | 1047636 | 1047707 | 71 | loss | 1703 | C7orf50 | N | 1 | 17 | 25.67 | Intron+ve, ASD > 4, Normals < 2, no Sanger filter applied |
| 7 | 136 | 1047636 | 1047707 | 71 | loss | 1726 | C7orf50 | N | 1 | 17 | 25.67 | Intron+ve, ASD > 4, Normals < 2, no Sanger filter applied |
| 7 | 136 | 1047636 | 1047707 | 71 | loss | 1797 | C7orf50 | N | 1 | 17 | 25.67 | Intron+ve, ASD > 4, Normals < 2, no Sanger filter applied |
| 7 | 136 | 1047636 | 1047707 | 71 | loss | 1843 | C7orf50 | N | 1 | 17 | 25.67 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 7 | 136 | 1047636 | 1047707 | 71 | loss | 1928 | C7orf50 | N | 1 | 17 | 25.67 | Intron+ve, ASD > 4, Normals < 2, no Sanger filter applied |
| 7 | 136 | 1047636 | 1047707 | 71 | loss | 1960 | C7orf50 | N | 1 | 17 | 25.67 | Intron+ve, ASD > 4, Normals < 2, no Sanger filter applied |
| 7 | 136 | 1047636 | 1047707 | 71 | loss | 1963 | C7orf50 | N | 1 | 17 | 25.67 | Intron+ve, ASD > 4, Normals < 2, no Sanger filter applied |
| 7 | 136 | 1047636 | 1047707 | 71 | loss | 1966 | C7orf50 | N | 1 | 17 | 25.67 | Intron+ve, ASD > 4, Normals < 2, no Sanger filter applied |
| 7 | 136 | 1047636 | 1047707 | 71 | loss | 2018 | C7orf50 | N | 1 | 17 | 25.67 | Intron+ve, ASD > 4, Normals < 2, no Sanger filter applied |
| 7 | 136 | 1047636 | 1047707 | 71 | loss | 2032 | C7orf50 | N | 1 | 17 | 25.67 | Intron+ve, ASD > 4, Normals < 2, no Sanger filter applied |
| 7 | 137 | 3496005 | 3497686 | 1,681 | loss | 1422 | SDK1 | N | 0 | 7 | 10.41 | Intron+ve, ASD > 4, Normals < 2, no Sanger filter applied |
| 7 | 137 | 3496005 | 3497686 | 1,681 | loss | 1423 | SDK1 | N | 0 | 7 | 10.41 | Intron+ve, ASD > 4, Normals < 2, no Sanger filter applied |
| 7 | 137 | 3496005 | 3497686 | 1,681 | loss | 1561 | SDK1 | N | 0 | 7 | 10.41 | Intron+ve, ASD > 4, Normals < 2, no Sanger filter applied |
| 7 | 137 | 3496005 | 3497686 | 1,681 | loss | 1834 | SDK1 | N | 0 | 7 | 10.41 | Intron+ve, ASD > 4, Normals < 2, no Sanger filter applied |
| 7 | 137 | 3496005 | 3497686 | 1,681 | loss | 1893 | SDK1 | N | 0 | 7 | 10.41 | Intron+ve, ASD > 4, Normals < 2, no Sanger filter applied |
| 7 | 137 | 3496005 | 3497686 | 1,681 | loss | 1905 | SDK1 | N | 0 | 7 | 10.41 | Intron+ve, ASD > 4, Normals < 2, no Sanger filter applied |
| 7 | 137 | 3496005 | 3497686 | 1,681 | loss | 1948 | SDK1 | N | 0 | 7 | 10.41 | Intron+ve, ASD > 4, Normals < 2, no Sanger filter applied |
| 7 | 138 | 4042651 | 4049103 | 6,452 | loss | 1306 | SDK1 | N | 0 | 7 | 10.41 | Intron+ve, ASD > 4, Normals < 2, no Sanger filter applied |
| 7 | 138 | 4042651 | 4049103 | 6,452 | loss | 1418 | SDK1 | N | 0 | 7 | 10.41 | Intron+ve, ASD > 4, Normals < 2, no Sanger filter applied |
| 7 | 138 | 4042651 | 4049103 | 6,452 | loss | 1493 | SDK1 | N | 0 | 7 | 10.41 | Intron+ve, ASD > 4, Normals < 2, no Sanger filter applied |
| 7 | 138 | 4042651 | 4049103 | 6,452 | loss | 1502 | SDK1 | N | 0 | 7 | 10.41 | Intron+ve, ASD > 4, Normals < 2, no Sanger filter applied |
| 7 | 138 | 4042651 | 4049103 | 6,452 | loss | 1647 | SDK1 | N | 0 | 7 | 10.41 | Intron+ve, ASD > 4, Normals < 2, no Sanger filter applied |
| 7 | 138 | 4042651 | 4049103 | 6,452 | loss | 1711 | SDK1 | N | 0 | 7 | 10.41 | Intron+ve, ASD > 4, Normals < 2, no Sanger filter applied |
| 7 | 138 | 4042651 | 4049103 | 6,452 | loss | 1751 | SDK1 | N | 0 | 7 | 10.41 | Intron+ve, ASD > 4, Normals < 2, no Sanger filter applied |
| 7 | 139 | 5138605 | 5148416 | 9,811 | loss | 1548 | ZNF890P | Y | 1 | 2 | 2.95 | Exon+ve, 5 > ASD > 1, Normals < 2, Sanger-ve |
| 7 | 139 | 5138605 | 5148416 | 9,811 | loss | 1727 | ZNF890P | Y | 1 | 2 | 2.95 | Exon+ve, 5 > ASD > 1, Normals < 2, Sanger-ve |
| 7 | 140 | 5825982 | 5831318 | 5,336 | gain | 1711 | ZNF815 | Y | 1 | 2 | 2.95 | Exon+ve, 5 > ASD > 1, Normals < 2, Sanger-ve |
| 7 | 140 | 5825982 | 5831318 | 5,336 | loss | 1967 | ZNF815 | Y | 1 | 2 | 2.95 | Exon+ve, 5 > ASD > 1, Normals < 2, Sanger-ve |
| 7 | 141 | 16866725 | 16883040 | 16,315 | gain | 1755 | AGR3 | Y | 1 | 2 | 2.95 | Exon+ve, 5 > ASD > 1, Normals < 2, Sanger-ve |
| 7 | 141 | 16866725 | 16883040 | 16,315 | loss | 1835 | AGR3 | Y | 1 | 2 | 2.95 | Exon+ve, 5 > ASD > 1, Normals < 2, Sanger-ve |
| 7 | 142 | 23802428 | 23802515 | 87 | loss | 1413 | STK31 | N | 0 | 6 | 8.91 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 7 | 142 | 23802428 | 23802515 | 87 | loss | 1472 | STK31 | N | 0 | 6 | 8.91 | Intron+ve, ASD > 4, Normals < 2, no Sanger filter applied |
| 7 | 142 | 23802428 | 23802515 | 87 | loss | 1583 | STK31 | N | 0 | 6 | 8.91 | Intron+ve, ASD > 4, Normals < 2, no Sanger filter applied |
| 7 | 142 | 23802428 | 23802515 | 87 | loss | 1584 | STK31 | N | 0 | 6 | 8.91 | Intron+ve, ASD > 4, Normals < 2, no Sanger filter applied |
| 7 | 142 | 23802428 | 23802515 | 87 | loss | 1619 | STK31 | N | 0 | 6 | 8.91 | Intron+ve, ASD > 4, Normals < 2, no Sanger filter applied |
| 7 | 142 | 23802428 | 23802515 | 87 | loss | 1960 | STK31 | N | 0 | 6 | 8.91 | Intron+ve, ASD > 4, Normals < 2, no Sanger filter applied |
| 7 | 143 | 48443511 | 48449543 | 6,032 | gain | 1223 | ABCA13 | N | 0 | 7 | 10.41 | Intron+ve, ASD > 4, Normals < 2, no Sanger filter applied |
| 7 | 143 | 48443511 | 48449543 | 6,032 | gain | 1273 | ABCA13 | N | 0 | 7 | 10.41 | Intron+ve, ASD > 4, Normals < 2, no Sanger filter applied |
| 7 | 143 | 48443511 | 48449543 | 6,032 | gain | 1583 | ABCA13 | N | 0 | 7 | 10.41 | Intron+ve, ASD > 4, Normals < 2, no Sanger filter applied |
| 7 | 143 | 48443511 | 48449543 | 6,032 | gain | 1615 | ABCA13 | N | 0 | 7 | 10.41 | Intron+ve, ASD > 4, Normals < 2, no Sanger filter applied |
| 7 | 143 | 48443511 | 48449543 | 6,032 | gain | 1886 | ABCA13 | N | 0 | 7 | 10.41 | Intron+ve, ASD > 4, Normals < 2, no Sanger filter applied |
| 7 | 143 | 48443511 | 48449543 | 6,032 | gain | 1891 | ABCA13 | N | 0 | 7 | 10.41 | Intron+ve, ASD > 4, Normals < 2, no Sanger filter applied |
| 7 | 143 | 48443511 | 48449543 | 6,032 | gain | 2028 | ABCA13 | N | 0 | 7 | 10.41 | Intron+ve, ASD > 4, Normals < 2, no Sanger filter applied |
| 7 | 144 | 62313534 | 62480276 | 166,742 | gain | 1389 | LOC100287834, LOC100287704, LOC643955 | Y | 1 | 2 | 2.95 | Exon+ve, 5 > ASD > 1, Normals < 2, Sanger-ve |
| 7 | 144 | 62313534 | 62480276 | 166,742 | gain | 1567 | LOC100287834, LOC100287704, LOC643955 | Y | 1 | 2 | 2.95 | Exon+ve, 5 > ASD > 1, Normals < 2, Sanger-ve |
| 7 | 145 | 71487316 | 71491600 | 4,284 | loss | 1677 | CALN1 | N | 0 | 8 | 11.92 | Intron+ve, ASD > 4, Normals < 2, no Sanger filter applied |
| 7 | 145 | 71487316 | 71491600 | 4,284 | loss | 1718 | CALN1 | N | 0 | 8 | 11.92 | Intron+ve, ASD > 4, Normals < 2, no Sanger filter applied |
| 7 | 145 | 71487316 | 71491600 | 4,284 | loss | 1724 | CALN1 | N | 0 | 8 | 11.92 | Intron+ve, ASD > 4, Normals < 2, no Sanger filter applied |
| 7 | 145 | 71487316 | 71491600 | 4,284 | loss | 1727 | CALN1 | N | 0 | 8 | 11.92 | Intron+ve, ASD > 4, Normals < 2, no Sanger filter applied |
| 7 | 145 | 71487316 | 71491600 | 4,284 | loss | 1735 | CALN1 | N | 0 | 8 | 11.92 | Intron+ve, ASD > 4, Normals < 2, no Sanger filter applied |
| 7 | 145 | 71487316 | 71491600 | 4,284 | loss | 1743 | CALN1 | N | 0 | 8 | 11.92 | Intron+ve, ASD > 4, Normals < 2, no Sanger filter applied |
| 7 | 145 | 71487316 | 71491600 | 4,284 | loss | 1751 | CALN1 | N | 0 | 8 | 11.92 | Intron+ve, ASD > 4, Normals < 2, no Sanger filter applied |
| 7 | 145 | 71487316 | 71491600 | 4,284 | loss | 1853 | CALN1 | N | 0 | 8 | 11.92 | Intron+ve, ASD > 4, Normals < 2, no Sanger filter applied |
| 7 | 146 | 100181105 | 100182350 | 1,245 | loss | 1227 | ZAN | Y | 0 | 10 | 14.94 | Exon+ve, ASD > 4, Normals < 2, no Sanger filter applied |
| 7 | 146 | 100181105 | 100182350 | 1,245 | loss | 1236 | ZAN | Y | 0 | 10 | 14.94 | Exon+ve, ASD > 4, Normals < 2, no Sanger filter applied |
| 7 | 146 | 100181105 | 100182350 | 1,245 | loss | 1771 | ZAN | Y | 0 | 10 | 14.94 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 7 | 146 | 100181105 | 100182350 | 1,245 | loss | 1777 | ZAN | Y | 0 | 10 | 14.94 | Exon+ve, ASD > 4, Normals < 2, no Sanger filter applied |
| 7 | 146 | 100181105 | 100182350 | 1,245 | loss | 1803 | ZAN | Y | 0 | 10 | 14.94 | Exon+ve, ASD > 4, Normals < 2, no Sanger filter applied |
| 7 | 146 | 100181105 | 100182350 | 1,245 | loss | 1824 | ZAN | Y | 0 | 10 | 14.94 | Exon+ve, ASD > 4, Normals < 2, no Sanger filter applied |
| 7 | 146 | 100181105 | 100182350 | 1,245 | loss | 1896 | ZAN | Y | 0 | 10 | 14.94 | Exon+ve, ASD > 4, Normals < 2, no Sanger filter applied |
| 7 | 146 | 100181105 | 100182350 | 1,245 | loss | 2020 | ZAN | Y | 0 | 10 | 14.94 | Exon+ve, ASD > 4, Normals < 2, no Sanger filter applied |
| 7 | 146 | 100181105 | 100182350 | 1,245 | loss | 2030 | ZAN | Y | 0 | 10 | 14.94 | Exon+ve, ASD > 4, Normals < 2, no Sanger filter applied |
| 7 | 146 | 100181105 | 100182350 | 1,245 | loss | 2034 | ZAN | Y | 0 | 10 | 14.94 | Exon+ve, ASD > 4, Normals < 2, no Sanger filter applied |
| 7 | 147 | 102465042 | 102496149 | 31,107 | gain | 1464 | FBXL13 | Y | 1 | 2 | 2.95 | Exon+ve, 5 > ASD > 1, Normals < 2, Sanger-ve |
| 7 | 147 | 102465042 | 102496149 | 31,107 | gain | 1997 | FBXL13 | Y | 1 | 2 | 2.95 | Exon+ve, 5 > ASD > 1, Normals < 2, Sanger-ve |
| 7 | 148 | 102496150 | 102520569 | 24,419 | gain | 1464 | ARMC10, FBXL13 | Y | 1 | 3 | 4.44 | Exon+ve, 5 > ASD > 1, Normals < 2, Sanger-ve |
| 7 | 148 | 102496150 | 102520569 | 24,419 | gain | 1848 | ARMC10, FBXL13 | Y | 1 | 3 | 4.44 | Exon+ve, 5 > ASD > 1, Normals < 2, Sanger-ve |
| 7 | 148 | 102496150 | 102520569 | 24,419 | gain | 1997 | ARMC10, FBXL13 | Y | 1 | 3 | 4.44 | Exon+ve, 5 > ASD > 1, Normals < 2, Sanger-ve |
| 7 | 149 | 102520570 | 102554005 | 33,435 | gain | 1464 | ARMC10, NAPEPLD | Y | 1 | 2 | 2.95 | Exon+ve, 5 > ASD > 1, Normals < 2, Sanger-ve |
| 7 | 149 | 102520570 | 102554005 | 33,435 | gain | 1997 | ARMC10, NAPEPLD | Y | 1 | 2 | 2.95 | Exon+ve, 5 > ASD > 1, Normals < 2, Sanger-ve |
| 7 | 150 | 104706525 | 104708287 | 1,762 | loss | 1286 | SRPK2 | N | 0 | 4 | 7.42 | Genic (distinct CNV-subregions); OR > 6 |
| 7 | 150 | 104706525 | 104708287 | 1,762 | loss | 1774 | SRPK2 | N | 0 | 4 | 7.42 | Genic (distinct CNV-subregions); OR > 6 |
| 7 | 150 | 104706525 | 104708287 | 1,762 | loss | 1839 | SRPK2 | N | 0 | 4 | 7.42 | Genic (distinct CNV-subregions); OR > 6 |
| 7 | 150 | 104706525 | 104708287 | 1,762 | loss | 1901 | SRPK2 | N | 0 | 4 | 7.42 | Genic (distinct CNV-subregions); OR > 6 |
| 7 | 151 | 104760047 | 104764319 | 4,272 | loss | 2033 | SRPK2 | N | 0 | 1 | 7.42 | Genic (distinct CNV-subregions); OR > 6 |
| 7 | 152 | 108696828 | 108700254 | 3,426 | gain | 1234 | | N | 0 | 20 | 30.33 | high OR intergenic (OR > 30) |
| 7 | 152 | 108696828 | 108700254 | 3,426 | gain | 1256 | | N | 0 | 20 | 30.33 | high OR intergenic (OR > 30) |
| 7 | 152 | 108696828 | 108700254 | 3,426 | gain | 1285 | | N | 0 | 20 | 30.33 | high OR intergenic (OR > 30) |
| 7 | 152 | 108696828 | 108700254 | 3,426 | loss | 1287 | | N | 0 | 20 | 30.33 | high OR intergenic (OR > 30) |
| 7 | 152 | 108696828 | 108700254 | 3,426 | gain | 1306 | | N | 0 | 20 | 30.33 | high OR intergenic (OR > 30) |
| 7 | 152 | 108696828 | 108700254 | 3,426 | gain | 1344 | | N | 0 | 20 | 30.33 | high OR intergenic (OR > 30) |
| 7 | 152 | 108696828 | 108700254 | 3,426 | gain | 1346 | | N | 0 | 20 | 30.33 | high OR intergenic (OR > 30) |
| 7 | 152 | 108696828 | 108700254 | 3,426 | gain | 1410 | | N | 0 | 20 | 30.33 | high OR intergenic (OR > 30) |
| 7 | 152 | 108696828 | 108700254 | 3,426 | gain | 1430 | | N | 0 | 20 | 30.33 | high OR intergenic (OR > 30) |
| 7 | 152 | 108696828 | 108700254 | 3,426 | gain | 1521 | | N | 0 | 20 | 30.33 | high OR intergenic (OR > 30) |
| 7 | 152 | 108696828 | 108700254 | 3,426 | gain | 1622 | | N | 0 | 20 | 30.33 | high OR intergenic (OR > 30) |
| 7 | 152 | 108696828 | 108700254 | 3,426 | gain | 1661 | | N | 0 | 20 | 30.33 | high OR intergenic (OR > 30) |
| 7 | 152 | 108696828 | 108700254 | 3,426 | gain | 1704 | | N | 0 | 20 | 30.33 | high OR intergenic (OR > 30) |
| 7 | 152 | 108696828 | 108700254 | 3,426 | gain | 1792 | | N | 0 | 20 | 30.33 | high OR intergenic (OR > 30) |
| 7 | 152 | 108696828 | 108700254 | 3,426 | gain | 1813 | | N | 0 | 20 | 30.33 | high OR intergenic (OR > 30) |
| 7 | 152 | 108696828 | 108700254 | 3,426 | gain | 1908 | | N | 0 | 20 | 30.33 | high OR intergenic (OR > 30) |
| 7 | 152 | 108696828 | 108700254 | 3,426 | gain | 1950 | | N | 0 | 20 | 30.33 | high OR intergenic (OR > 30) |
| 7 | 152 | 108696828 | 108700254 | 3,426 | gain | 1970 | | N | 0 | 20 | 30.33 | high OR intergenic (OR > 30) |
| 7 | 152 | 108696828 | 108700254 | 3,426 | gain | 2028 | | N | 0 | 20 | 30.33 | high OR intergenic (OR > 30) |
| 7 | 152 | 108696828 | 108700254 | 3,426 | gain | 2031 | | N | 0 | 20 | 30.33 | high OR intergenic (OR > 30) |
| 7 | 153 | 108700255 | 108706129 | 5,874 | gain | 1234 | | N | 0 | 24 | 36.62 | high OR intergenic (OR > 30) |
| 7 | 153 | 108700255 | 108706129 | 5,874 | gain | 1256 | | N | 0 | 24 | 36.62 | high OR intergenic (OR > 30) |
| 7 | 153 | 108700255 | 108706129 | 5,874 | gain | 1267 | | N | 0 | 24 | 36.62 | high OR intergenic (OR > 30) |
| 7 | 153 | 108700255 | 108706129 | 5,874 | gain | 1285 | | N | 0 | 24 | 36.62 | high OR intergenic (OR > 30) |
| 7 | 153 | 108700255 | 108706129 | 5,874 | loss | 1287 | | N | 0 | 24 | 36.62 | high OR intergenic (OR > 30) |
| 7 | 153 | 108700255 | 108706129 | 5,874 | gain | 1304 | | N | 0 | 24 | 36.62 | high OR intergenic (OR > 30) |
| 7 | 153 | 108700255 | 108706129 | 5,874 | gain | 1306 | | N | 0 | 24 | 36.62 | high OR intergenic (OR > 30) |
| 7 | 153 | 108700255 | 108706129 | 5,874 | gain | 1344 | | N | 0 | 24 | 36.62 | high OR intergenic (OR > 30) |
| 7 | 153 | 108700255 | 108706129 | 5,874 | gain | 1346 | | N | 0 | 24 | 36.62 | high OR intergenic (OR > 30) |
| 7 | 153 | 108700255 | 108706129 | 5,874 | gain | 1410 | | N | 0 | 24 | 36.62 | high OR intergenic (OR > 30) |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 7 | 153 | 108700255 | 108706129 | 5,874 | gain | 1423 | | N | 0 | 24 | 36.62 | high OR intergenic (OR > 30) |
| 7 | 153 | 108700255 | 108706129 | 5,874 | gain | 1430 | | N | 0 | 24 | 36.62 | high OR intergenic (OR > 30) |
| 7 | 153 | 108700255 | 108706129 | 5,874 | gain | 1521 | | N | 0 | 24 | 36.62 | high OR intergenic (OR > 30) |
| 7 | 153 | 108700255 | 108706129 | 5,874 | gain | 1622 | | N | 0 | 24 | 36.62 | high OR intergenic (OR > 30) |
| 7 | 153 | 108700255 | 108706129 | 5,874 | gain | 1629 | | N | 0 | 24 | 36.62 | high OR intergenic (OR > 30) |
| 7 | 153 | 108700255 | 108706129 | 5,874 | gain | 1661 | | N | 0 | 24 | 36.62 | high OR intergenic (OR > 30) |
| 7 | 153 | 108700255 | 108706129 | 5,874 | gain | 1704 | | N | 0 | 24 | 36.62 | high OR intergenic (OR > 30) |
| 7 | 153 | 108700255 | 108706129 | 5,874 | gain | 1792 | | N | 0 | 24 | 36.62 | high OR intergenic (OR > 30) |
| 7 | 153 | 108700255 | 108706129 | 5,874 | gain | 1813 | | N | 0 | 24 | 36.62 | high OR intergenic (OR > 30) |
| 7 | 153 | 108700255 | 108706129 | 5,874 | gain | 1908 | | N | 0 | 24 | 36.62 | high OR intergenic (OR > 30) |
| 7 | 153 | 108700255 | 108706129 | 5,874 | gain | 1950 | | N | 0 | 24 | 36.62 | high OR intergenic (OR > 30) |
| 7 | 153 | 108700255 | 108706129 | 5,874 | gain | 1970 | | N | 0 | 24 | 36.62 | high OR intergenic (OR > 30) |
| 7 | 153 | 108700255 | 108706129 | 5,874 | gain | 2028 | | N | 0 | 24 | 36.62 | high OR intergenic (OR > 30) |
| 7 | 153 | 108700255 | 108706129 | 5,874 | gain | 2031 | | N | 0 | 24 | 36.62 | high OR intergenic (OR > 30) |
| 7 | 154 | 118620876 | 118622741 | 1,865 | gain | 1222 | | N | 1 | 20 | 30.33 | high OR intergenic (OR > 30) |
| 7 | 154 | 118620876 | 118622741 | 1,865 | gain | 1323 | | N | 1 | 20 | 30.33 | high OR intergenic (OR > 30) |
| 7 | 154 | 118620876 | 118622741 | 1,865 | gain | 1374 | | N | 1 | 20 | 30.33 | high OR intergenic (OR > 30) |
| 7 | 154 | 118620876 | 118622741 | 1,865 | gain | 1485 | | N | 1 | 20 | 30.33 | high OR intergenic (OR > 30) |
| 7 | 154 | 118620876 | 118622741 | 1,865 | gain | 1533 | | N | 1 | 20 | 30.33 | high OR intergenic (OR > 30) |
| 7 | 154 | 118620876 | 118622741 | 1,865 | gain | 1543 | | N | 1 | 20 | 30.33 | high OR intergenic (OR > 30) |
| 7 | 154 | 118620876 | 118622741 | 1,865 | gain | 1568 | | N | 1 | 20 | 30.33 | high OR intergenic (OR > 30) |
| 7 | 154 | 118620876 | 118622741 | 1,865 | gain | 1601 | | N | 1 | 20 | 30.33 | high OR intergenic (OR > 30) |
| 7 | 154 | 118620876 | 118622741 | 1,865 | gain | 1612 | | N | 1 | 20 | 30.33 | high OR intergenic (OR > 30) |
| 7 | 154 | 118620876 | 118622741 | 1,865 | gain | 1616 | | N | 1 | 20 | 30.33 | high OR intergenic (OR > 30) |
| 7 | 154 | 118620876 | 118622741 | 1,865 | gain | 1635 | | N | 1 | 20 | 30.33 | high OR intergenic (OR > 30) |
| 7 | 154 | 118620876 | 118622741 | 1,865 | gain | 1665 | | N | 1 | 20 | 30.33 | high OR intergenic (OR > 30) |
| 7 | 154 | 118620876 | 118622741 | 1,865 | gain | 1740 | | N | 1 | 20 | 30.33 | high OR intergenic (OR > 30) |
| 7 | 154 | 118620876 | 118622741 | 1,865 | gain | 1766 | | N | 1 | 20 | 30.33 | high OR intergenic (OR > 30) |
| 7 | 154 | 118620876 | 118622741 | 1,865 | gain | 1783 | | N | 1 | 20 | 30.33 | high OR intergenic (OR > 30) |
| 7 | 154 | 118620876 | 118622741 | 1,865 | gain | 1834 | | N | 1 | 20 | 30.33 | high OR intergenic (OR > 30) |
| 7 | 154 | 118620876 | 118622741 | 1,865 | gain | 1876 | | N | 1 | 20 | 30.33 | high OR intergenic (OR > 30) |
| 7 | 154 | 118620876 | 118622741 | 1,865 | gain | 1921 | | N | 1 | 20 | 30.33 | high OR intergenic (OR > 30) |
| 7 | 154 | 118620876 | 118622741 | 1,865 | gain | 1926 | | N | 1 | 20 | 30.33 | high OR intergenic (OR > 30) |
| 7 | 154 | 118620876 | 118622741 | 1,865 | gain | 2030 | | N | 1 | 20 | 30.33 | high OR intergenic (OR > 30) |
| 7 | 155 | 141440185 | 141442231 | 2,046 | gain | 1225 | MGAM | Y | 1 | 5 | 7.42 | Exon+ve, ASD > 4, Normals < 2, no Sanger filter applied |
| 7 | 155 | 141440185 | 141442231 | 2,046 | gain | 1691 | MGAM | Y | 1 | 5 | 7.42 | Exon+ve, ASD > 4, Normals < 2, no Sanger filter applied |
| 7 | 155 | 141440185 | 141442231 | 2,046 | gain | 1720 | MGAM | Y | 1 | 5 | 7.42 | Exon+ve, ASD > 4, Normals < 2, no Sanger filter applied |
| 7 | 155 | 141440185 | 141442231 | 2,046 | gain | 1734 | MGAM | Y | 1 | 5 | 7.42 | Exon+ve, ASD > 4, Normals < 2, no Sanger filter applied |
| 7 | 155 | 141440185 | 141442231 | 2,046 | loss | 1897 | MGAM | Y | 1 | 5 | 7.42 | Exon+ve, ASD > 4, Normals < 2, no Sanger filter applied |
| 7 | 156 | 141442232 | 141443577 | 1,345 | gain | 1225 | MGAM | Y | 1 | 3 | 4.44 | Exon+ve, 5 > ASD > 1, Normals < 2, Sanger-ve |
| 7 | 156 | 141442232 | 141443577 | 1,345 | gain | 1691 | MGAM | Y | 1 | 3 | 4.44 | Exon+ve, 5 > ASD > 1, Normals < 2, Sanger-ve |
| 7 | 156 | 141442232 | 141443577 | 1,345 | gain | 1720 | MGAM | Y | 1 | 3 | 4.44 | Exon+ve, 5 > ASD > 1, Normals < 2, Sanger-ve |
| 7 | 157 | 142136345 | 142140539 | 4,194 | loss | 1232 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1242 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1347 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1349 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1374 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1386 | PRSS1 | Y | 0 | 30 | 46.2 | Exon+ve, ASD > 4, Normals < 2, no Sanger filter applied |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 7 | 157 | 142136345 | 142140539 | 4,194 | loss | 1568 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1573 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1601 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1604 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1660 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1667 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1697 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1720 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1753 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1780 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1784 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1793 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1803 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1830 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1837 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1844 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1867 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1884 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1921 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1930 | PRSS1 | Y | 0 | 30 | 46.2 | Exon+ve, ASD > 4, Normals < 2, no Sanger filter applied |
| 7 | 157 | 142136345 | 142140539 | 4,194 | loss | 1937 | PRSS1 | Y | 0 | 30 | 46.2 | Exon+ve, ASD > 4, Normals < 2, no Sanger filter applied |
| 7 | 157 | 142136345 | 142140539 | 4,194 | loss | 2018 | PRSS1 | Y | 0 | 30 | 46.2 | Exon+ve, ASD > 4, Normals < 2, no Sanger filter applied |
| 7 | 157 | 142136345 | 142140539 | 4,194 | loss | 2024 | PRSS1 | Y | 0 | 30 | 46.2 | Exon+ve, ASD > 4, Normals < 2, no Sanger filter applied |
| 7 | 157 | 142136345 | 142140539 | 4,194 | loss | 2041 | PRSS1 | Y | 0 | 30 | 46.2 | Exon+ve, ASD > 4, Normals < 2, no Sanger filter applied |
| 7 | 158 | 142176075 | 142187072 | 10,997 | loss | 1232 | PRSS2 | Y | 4 | 46 | 18.1 | Genic (distinct CNV-subregions); OR > 6 |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 7 | 158 | 142176075 | 142187072 | 10,997 | loss | 1242 | PRSS2 | Y | 4 | 46 | 18.1 | Genic (distinct CNV-subregions); OR > 6 |
| 7 | 158 | 142176075 | 142187072 | 10,997 | loss | 1308 | PRSS2 | Y | 4 | 46 | 18.1 | Genic (distinct CNV-subregions); OR > 6 |
| 7 | 158 | 142176075 | 142187072 | 10,997 | loss | 1347 | PRSS2 | Y | 4 | 46 | 18.1 | Genic (distinct CNV-subregions); OR > 6 |
| 7 | 158 | 142176075 | 142187072 | 10,997 | loss | 1391 | PRSS2 | Y | 4 | 46 | 18.1 | Genic (distinct CNV-subregions); OR > 6 |
| 7 | 158 | 142176075 | 142187072 | 10,997 | loss | 1392 | PRSS2 | Y | 4 | 46 | 18.1 | Genic (distinct CNV-subregions); OR > 6 |
| 7 | 158 | 142176075 | 142187072 | 10,997 | loss | 1401 | PRSS2 | Y | 4 | 46 | 18.1 | Genic (distinct CNV-subregions); OR > 6 |
| 7 | 158 | 142176075 | 142187072 | 10,997 | gain | 1446 | PRSS2 | Y | 4 | 46 | 18.1 | Genic (distinct CNV-subregions); OR > 6 |
| 7 | 158 | 142176075 | 142187072 | 10,997 | loss | 1465 | PRSS2 | Y | 4 | 46 | 18.1 | Genic (distinct CNV-subregions); OR > 6 |
| 7 | 158 | 142176075 | 142187072 | 10,997 | loss | 1532 | PRSS2 | Y | 4 | 46 | 18.1 | Genic (distinct CNV-subregions); OR > 6 |
| 7 | 158 | 142176075 | 142187072 | 10,997 | loss | 1568 | PRSS2 | Y | 4 | 46 | 18.1 | Genic (distinct CNV-subregions); OR > 6 |
| 7 | 158 | 142176075 | 142187072 | 10,997 | loss | 1601 | PRSS2 | Y | 4 | 46 | 18.1 | Genic (distinct CNV-subregions); OR > 6 |
| 7 | 158 | 142176075 | 142187072 | 10,997 | loss | 1604 | PRSS2 | Y | 4 | 46 | 18.1 | Genic (distinct CNV-subregions); OR > 6 |
| 7 | 158 | 142176075 | 142187072 | 10,997 | loss | 1621 | PRSS2 | Y | 4 | 46 | 18.1 | Genic (distinct CNV-subregions); OR > 6 |
| 7 | 158 | 142176075 | 142187072 | 10,997 | loss | 1622 | PRSS2 | Y | 4 | 46 | 18.1 | Genic (distinct CNV-subregions); OR > 6 |
| 7 | 158 | 142176075 | 142187072 | 10,997 | loss | 1638 | PRSS2 | Y | 4 | 46 | 18.1 | Genic (distinct CNV-subregions); OR > 6 |
| 7 | 158 | 142176075 | 142187072 | 10,997 | loss | 1640 | PRSS2 | Y | 4 | 46 | 18.1 | Genic (distinct CNV-subregions); OR > 6 |
| 7 | 158 | 142176075 | 142187072 | 10,997 | loss | 1660 | PRSS2 | Y | 4 | 46 | 18.1 | Genic (distinct CNV-subregions); OR > 6 |
| 7 | 158 | 142176075 | 142187072 | 10,997 | gain | 1694 | PRSS2 | Y | 4 | 46 | 18.1 | Genic (distinct CNV-subregions); OR > 6 |
| 7 | 158 | 142176075 | 142187072 | 10,997 | loss | 1697 | PRSS2 | Y | 4 | 46 | 18.1 | Genic (distinct CNV-subregions); OR > 6 |
| 7 | 158 | 142176075 | 142187072 | 10,997 | loss | 1752 | PRSS2 | Y | 4 | 46 | 18.1 | Genic (distinct CNV-subregions); OR > 6 |
| 7 | 158 | 142176075 | 142187072 | 10,997 | loss | 1753 | PRSS2 | Y | 4 | 46 | 18.1 | Genic (distinct CNV-subregions); OR > 6 |
| 7 | 158 | 142176075 | 142187072 | 10,997 | loss | 1780 | PRSS2 | Y | 4 | 46 | 18.1 | Genic (distinct CNV-subregions); OR > 6 |
| 7 | 158 | 142176075 | 142187072 | 10,997 | loss | 1784 | PRSS2 | Y | 4 | 46 | 18.1 | Genic (distinct CNV-subregions); OR > 6 |
| 7 | 158 | 142176075 | 142187072 | 10,997 | loss | 1788 | PRSS2 | Y | 4 | 46 | 18.1 | Genic (distinct CNV-subregions); OR > 6 |
| 7 | 158 | 142176075 | 142187072 | 10,997 | loss | 1793 | PRSS2 | Y | 4 | 46 | 18.1 | Genic (distinct CNV-subregions); OR > 6 |
| 7 | 158 | 142176075 | 142187072 | 10,997 | gain | 1794 | PRSS2 | Y | 4 | 46 | 18.1 | Genic (distinct CNV-subregions); OR > 6 |
| 7 | 158 | 142176075 | 142187072 | 10,997 | loss | 1803 | PRSS2 | Y | 4 | 46 | 18.1 | Genic (distinct CNV-subregions); OR > 6 |
| 7 | 158 | 142176075 | 142187072 | 10,997 | loss | 1806 | PRSS2 | Y | 4 | 46 | 18.1 | Genic (distinct CNV-subregions); OR > 6 |
| 7 | 158 | 142176075 | 142187072 | 10,997 | loss | 1824 | PRSS2 | Y | 4 | 46 | 18.1 | Genic (distinct CNV-subregions); OR > 6 |
| 7 | 158 | 142176075 | 142187072 | 10,997 | loss | 1830 | PRSS2 | Y | 4 | 46 | 18.1 | Genic (distinct CNV-subregions); OR > 6 |
| 7 | 158 | 142176075 | 142187072 | 10,997 | loss | 1837 | PRSS2 | Y | 4 | 46 | 18.1 | Genic (distinct CNV-subregions); OR > 6 |
| 7 | 158 | 142176075 | 142187072 | 10,997 | loss | 1838 | PRSS2 | Y | 4 | 46 | 18.1 | Genic (distinct CNV-subregions); OR > 6 |
| 7 | 158 | 142176075 | 142187072 | 10,997 | loss | 1844 | PRSS2 | Y | 4 | 46 | 18.1 | Genic (distinct CNV-subregions); OR > 6 |
| 7 | 158 | 142176075 | 142187072 | 10,997 | loss | 1845 | PRSS2 | Y | 4 | 46 | 18.1 | Genic (distinct CNV-subregions); OR > 6 |
| 7 | 158 | 142176075 | 142187072 | 10,997 | loss | 1884 | PRSS2 | Y | 4 | 46 | 18.1 | Genic (distinct CNV-subregions); OR > 6 |
| 7 | 158 | 142176075 | 142187072 | 10,997 | loss | 1894 | PRSS2 | Y | 4 | 46 | 18.1 | Genic (distinct CNV-subregions); OR > 6 |
| 7 | 158 | 142176075 | 142187072 | 10,997 | loss | 1897 | PRSS2 | Y | 4 | 46 | 18.1 | Genic (distinct CNV-subregions); OR > 6 |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 7 | 158 | 142176075 | 142187072 | 10,997 | loss | 1914 | PRSS2 | Y | 4 | 46 | 18.1 | Genic (distinct CNV-subregions); OR > 6 |
| 7 | 158 | 142176075 | 142187072 | 10,997 | loss | 1921 | PRSS2 | Y | 4 | 46 | 18.1 | Genic (distinct CNV-subregions); OR > 6 |
| 7 | 158 | 142176075 | 142187072 | 10,997 | loss | 1930 | PRSS2 | Y | 4 | 46 | 18.1 | Genic (distinct CNV-subregions); OR > 6 |
| 7 | 158 | 142176075 | 142187072 | 10,997 | loss | 1937 | PRSS2 | Y | 4 | 46 | 18.1 | Genic (distinct CNV-subregions); OR > 6 |
| 7 | 158 | 142176075 | 142187072 | 10,997 | gain | 1997 | PRSS2 | Y | 4 | 46 | 18.1 | Genic (distinct CNV-subregions); OR > 6 |
| 7 | 158 | 142176075 | 142187072 | 10,997 | loss | 2018 | PRSS2 | Y | 4 | 46 | 18.1 | Genic (distinct CNV-subregions); OR > 6 |
| 7 | 158 | 142176075 | 142187072 | 10,997 | loss | 2020 | PRSS2 | Y | 4 | 46 | 18.1 | Genic (distinct CNV-subregions); OR > 6 |
| 7 | 158 | 142176075 | 142187072 | 10,997 | loss | 2024 | PRSS2 | Y | 4 | 46 | 18.1 | Genic (distinct CNV-subregions); OR > 6 |
| 7 | 159 | 145855888 | 145857190 | 1,302 | gain | 1236 | CNTNAP2 | N | 0 | 5 | 7.42 | Intron+ve, ASD > 4, Normals < 2, no Sanger filter applied |
| 7 | 159 | 145855888 | 145857190 | 1,302 | gain | 1718 | CNTNAP2 | N | 0 | 5 | 7.42 | Intron+ve, ASD > 4, Normals < 2, no Sanger filter applied |
| 7 | 159 | 145855888 | 145857190 | 1,302 | gain | 1752 | CNTNAP2 | N | 0 | 5 | 7.42 | Intron+ve, ASD > 4, Normals < 2, no Sanger filter applied |
| 7 | 159 | 145855888 | 145857190 | 1,302 | gain | 1762 | CNTNAP2 | N | 0 | 5 | 7.42 | Intron+ve, ASD > 4, Normals < 2, no Sanger filter applied |
| 7 | 159 | 145855888 | 145857190 | 1,302 | gain | 1871 | CNTNAP2 | N | 0 | 5 | 7.42 | Intron+ve, ASD > 4, Normals < 2, no Sanger filter applied |
| 7 | 160 | 145857191 | 145862540 | 5,349 | gain | 1236 | CNTNAP2 | N | 1 | 5 | 7.42 | Intron+ve, ASD > 4, Normals < 2, no Sanger filter applied |
| 7 | 160 | 145857191 | 145862540 | 5,349 | gain | 1718 | CNTNAP2 | N | 1 | 5 | 7.42 | Intron+ve, ASD > 4, Normals < 2, no Sanger filter applied |
| 7 | 160 | 145857191 | 145862540 | 5,349 | gain | 1752 | CNTNAP2 | N | 1 | 5 | 7.42 | Intron+ve, ASD > 4, Normals < 2, no Sanger filter applied |
| 7 | 160 | 145857191 | 145862540 | 5,349 | gain | 1762 | CNTNAP2 | N | 1 | 5 | 7.42 | Intron+ve, ASD > 4, Normals < 2, no Sanger filter applied |
| 7 | 160 | 145857191 | 145862540 | 5,349 | gain | 1871 | CNTNAP2 | N | 1 | 5 | 7.42 | Intron+ve, ASD > 4, Normals < 2, no Sanger filter applied |
| 7 | 161 | 145862541 | 145885711 | 23,170 | gain | 1236 | CNTNAP2 | N | 0 | 5 | 7.42 | Intron+ve, ASD > 4, Normals < 2, no Sanger filter applied |
| 7 | 161 | 145862541 | 145885711 | 23,170 | gain | 1718 | CNTNAP2 | N | 0 | 5 | 7.42 | Intron+ve, ASD > 4, Normals < 2, no Sanger filter applied |
| 7 | 161 | 145862541 | 145885711 | 23,170 | gain | 1752 | CNTNAP2 | N | 0 | 5 | 7.42 | Intron+ve, ASD > 4, Normals < 2, no Sanger filter applied |
| 7 | 161 | 145862541 | 145885711 | 23,170 | gain | 1762 | CNTNAP2 | N | 0 | 5 | 7.42 | Intron+ve, ASD > 4, Normals < 2, no Sanger filter applied |
| 7 | 161 | 145862541 | 145885711 | 23,170 | gain | 1871 | CNTNAP2 | N | 0 | 5 | 7.42 | Intron+ve, ASD > 4, Normals < 2, no Sanger filter applied |
| 7 | 162 | 147708383 | 147710037 | 1,654 | loss | 1227 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1279 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1324 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1346 | CNTNAP2 | N | 0 | 41 | 64.22 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 7 | 162 | 147708383 | 147710037 | 1,654 | gain | 1423 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1517 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1621 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1636 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1639 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1645 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1670 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1718 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1727 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1728 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1753 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1754 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1759 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1761 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1792 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1806 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1820 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1826 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1836 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1850 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1854 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1857 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1867 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1868 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1872 | CNTNAP2 | N | 0 | 41 | 64.22 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 7 | 162 | 147708383 | 147710037 | 1,654 | loss | 1911 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1916 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1918 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1943 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1960 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1967 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 1998 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 2003 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 2004 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 2022 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 2028 | CNTNAP2 | N | 0 | 41 | 64.22 | Intron+ve, ASD > 4, Normals < 2, no Sanger filter applied |
| 7 | 162 | 147708383 | 147710037 | 1,654 | loss | 2041 | CNTNAP2 | N | 0 | 41 | 64.22 | Intron+ve, ASD > 4, Normals < 2, no Sanger filter applied |
| 7 | 163 | 149183338 | 149191205 | 7,867 | gain | 1486 | ZNF862 | Y | 1 | 2 | 2.95 | Exon+ve, 5 > ASD > 1, Normals < 2, Sanger-ve |
| 7 | 163 | 149183338 | 149191205 | 7,867 | gain | 1755 | ZNF862 | Y | 1 | 2 | 2.95 | Exon+ve, 5 > ASD > 1, Normals < 2, Sanger-ve |
| 7 | 164 | 149192529 | 149210297 | 17,768 | gain | 1486 | LOC401431, ATP6V0E2, ZNF862 | Y | 1 | 2 | 2.95 | Exon+ve, 5 > ASD > 1, Normals < 2, Sanger-ve |
| 7 | 164 | 149192529 | 149210297 | 17,768 | gain | 1755 | LOC401431, ATP6V0E2, ZNF862 | Y | 1 | 2 | 2.95 | Exon+ve, 5 > ASD > 1, Normals < 2, Sanger-ve |
| 7 | 165 | 153860688 | 153865845 | 5,157 | loss | 1297 | DPP6 | N | 1 | 5 | 7.42 | Intron+ve, ASD > 4, Normals < 2, no Sanger filter applied |
| 7 | 165 | 153860688 | 153865845 | 5,157 | loss | 1316 | DPP6 | N | 1 | 5 | 7.42 | Intron+ve, ASD > 4, Normals < 2, no Sanger filter applied |
| 7 | 165 | 153860688 | 153865845 | 5,157 | gain | 1730 | DPP6 | N | 1 | 5 | 7.42 | Intron+ve, ASD > 4, Normals < 2, no Sanger filter applied |
| 7 | 165 | 153860688 | 153865845 | 5,157 | loss | 1786 | DPP6 | N | 1 | 5 | 7.42 | Intron+ve, ASD > 4, Normals < 2, no Sanger filter applied |
| 7 | 165 | 153860688 | 153865845 | 5,157 | loss | 1835 | DPP6 | N | 1 | 5 | 7.42 | Intron+ve, ASD > 4, Normals < 2, no Sanger filter applied |
| 7 | 166 | 154028650 | 154032130 | 3,480 | gain | 1241 | DPP6 | N | 0 | 67 | 109.38 | Intron+ve, ASD > 4, Normals < 2, no Sanger filter applied |
| 7 | 166 | 154028650 | 154032130 | 3,480 | loss | 1272 | DPP6 | N | 0 | 67 | 109.38 | Intron+ve, ASD > 4, Normals < 2, no Sanger filter applied |
| 7 | 166 | 154028650 | 154032130 | 3,480 | loss | 1295 | DPP6 | N | 0 | 67 | 109.38 | Intron+ve, ASD > 4, Normals < 2, no Sanger filter applied |
| 7 | 166 | 154028650 | 154032130 | 3,480 | loss | 1297 | DPP6 | N | 0 | 67 | 109.38 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 7 | 166 | 154028650 | 154032130 | 3,480 | gain | 1307 | DPP6 | N | 0 | 67 | 109.38 | Intron+ve, ASD > 4, Normals < 2, no Sanger filter applied |
| 7 | 166 | 154028650 | 154032130 | 3,480 | gain | 1323 | DPP6 | N | 0 | 67 | 109.38 | Intron+ve, ASD > 4, Normals < 2, no Sanger filter applied |
| 7 | 166 | 154028650 | 154032130 | 3,480 | loss | 1400 | DPP6 | N | 0 | 67 | 109.38 | Intron+ve, ASD > 4, Normals < 2, no Sanger filter applied |
| 7 | 166 | 154028650 | 154032130 | 3,480 | loss | 1405 | DPP6 | N | 0 | 67 | 109.38 | Intron+ve, ASD > 4, Normals < 2, no Sanger filter applied |
| 7 | 166 | 154028650 | 154032130 | 3,480 | gain | 1406 | DPP6 | N | 0 | 67 | 109.38 | Intron+ve, ASD > 4, Normals < 2, no Sanger filter applied |
| 7 | 166 | 154028650 | 154032130 | 3,480 | gain | 1414 | DPP6 | N | 0 | 67 | 109.38 | Intron+ve, ASD > 4, Normals < 2, no Sanger filter applied |
| 7 | 166 | 154028650 | 154032130 | 3,480 | loss | 1448 | DPP6 | N | 0 | 67 | 109.38 | Intron+ve, ASD > 4, Normals < 2, no Sanger filter applied |
| 7 | 166 | 154028650 | 154032130 | 3,480 | loss | 1463 | DPP6 | N | 0 | 67 | 109.38 | Intron+ve, ASD > 4, Normals < 2, no Sanger filter applied |
| 7 | 166 | 154028650 | 154032130 | 3,480 | loss | 1468 | DPP6 | N | 0 | 67 | 109.38 | Intron+ve, ASD > 4, Normals < 2, no Sanger filter applied |
| 7 | 166 | 154028650 | 154032130 | 3,480 | gain | 1492 | DPP6 | N | 0 | 67 | 109.38 | Intron+ve, ASD > 4, Normals < 2, no Sanger filter applied |
| 7 | 166 | 154028650 | 154032130 | 3,480 | gain | 1510 | DPP6 | N | 0 | 67 | 109.38 | Intron+ve, ASD > 4, Normals < 2, no Sanger filter applied |
| 7 | 166 | 154028650 | 154032130 | 3,480 | loss | 1536 | DPP6 | N | 0 | 67 | 109.38 | Intron+ve, ASD > 4, Normals < 2, no Sanger filter applied |
| 7 | 166 | 154028650 | 154032130 | 3,480 | loss | 1538 | DPP6 | N | 0 | 67 | 109.38 | Intron+ve, ASD > 4, Normals < 2, no Sanger filter applied |
| 7 | 166 | 154028650 | 154032130 | 3,480 | loss | 1539 | DPP6 | N | 0 | 67 | 109.38 | Intron+ve, ASD > 4, Normals < 2, no Sanger filter applied |
| 7 | 166 | 154028650 | 154032130 | 3,480 | loss | 1544 | DPP6 | N | 0 | 67 | 109.38 | Intron+ve, ASD > 4, Normals < 2, no Sanger filter applied |
| 7 | 166 | 154028650 | 154032130 | 3,480 | loss | 1545 | DPP6 | N | 0 | 67 | 109.38 | Intron+ve, ASD > 4, Normals < 2, no Sanger filter applied |
| 7 | 166 | 154028650 | 154032130 | 3,480 | gain | 1555 | DPP6 | N | 0 | 67 | 109.38 | Intron+ve, ASD > 4, Normals < 2, no Sanger filter applied |
| 7 | 166 | 154028650 | 154032130 | 3,480 | gain | 1563 | DPP6 | N | 0 | 67 | 109.38 | Intron+ve, ASD > 4, Normals < 2, no Sanger filter applied |
| 7 | 166 | 154028650 | 154032130 | 3,480 | gain | 1564 | DPP6 | N | 0 | 67 | 109.38 | Intron+ve, ASD > 4, Normals < 2, no Sanger filter applied |
| 7 | 166 | 154028650 | 154032130 | 3,480 | loss | 1572 | DPP6 | N | 0 | 67 | 109.38 | Intron+ve, ASD > 4, Normals < 2, no Sanger filter applied |
| 7 | 166 | 154028650 | 154032130 | 3,480 | loss | 1574 | DPP6 | N | 0 | 67 | 109.38 | Intron+ve, ASD > 4, Normals < 2, no Sanger filter applied |
| 7 | 166 | 154028650 | 154032130 | 3,480 | loss | 1577 | DPP6 | N | 0 | 67 | 109.38 | Intron+ve, ASD > 4, Normals < 2, no Sanger filter applied |
| 7 | 166 | 154028650 | 154032130 | 3,480 | gain | 1621 | DPP6 | N | 0 | 67 | 109.38 | Intron+ve, ASD > 4, Normals < 2, no Sanger filter applied |
| 7 | 166 | 154028650 | 154032130 | 3,480 | gain | 1624 | DPP6 | N | 0 | 67 | 109.38 | Intron+ve, ASD > 4, Normals < 2, no Sanger filter applied |
| 7 | 166 | 154028650 | 154032130 | 3,480 | gain | 1637 | DPP6 | N | 0 | 67 | 109.38 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 7 | 166 | 154028650 | 154032130 | 3,480 | gain | 1647 | DPP6 | N | 0 | 67 | 109.38 | Intron+ve, ASD > 4, Normals < 2, no Sanger filter applied |
| 7 | 166 | 154028650 | 154032130 | 3,480 | loss | 1657 | DPP6 | N | 0 | 67 | 109.38 | Intron+ve, ASD > 4, Normals < 2, no Sanger filter applied |
| 7 | 166 | 154028650 | 154032130 | 3,480 | loss | 1658 | DPP6 | N | 0 | 67 | 109.38 | Intron+ve, ASD > 4, Normals < 2, no Sanger filter applied |
| 7 | 166 | 154028650 | 154032130 | 3,480 | loss | 1662 | DPP6 | N | 0 | 67 | 109.38 | Intron+ve, ASD > 4, Normals < 2, no Sanger filter applied |
| 7 | 166 | 154028650 | 154032130 | 3,480 | loss | 1664 | DPP6 | N | 0 | 67 | 109.38 | Intron+ve, ASD > 4, Normals < 2, no Sanger filter applied |
| 7 | 166 | 154028650 | 154032130 | 3,480 | loss | 1668 | DPP6 | N | 0 | 67 | 109.38 | Intron+ve, ASD > 4, Normals < 2, no Sanger filter applied |
| 7 | 166 | 154028650 | 154032130 | 3,480 | loss | 1669 | DPP6 | N | 0 | 67 | 109.38 | Intron+ve, ASD > 4, Normals < 2, no Sanger filter applied |
| 7 | 166 | 154028650 | 154032130 | 3,480 | gain | 1670 | DPP6 | N | 0 | 67 | 109.38 | Intron+ve, ASD > 4, Normals < 2, no Sanger filter applied |
| 7 | 166 | 154028650 | 154032130 | 3,480 | loss | 1689 | DPP6 | N | 0 | 67 | 109.38 | Intron+ve, ASD > 4, Normals < 2, no Sanger filter applied |
| 7 | 166 | 154028650 | 154032130 | 3,480 | loss | 1692 | DPP6 | N | 0 | 67 | 109.38 | Intron+ve, ASD > 4, Normals < 2, no Sanger filter applied |
| 7 | 166 | 154028650 | 154032130 | 3,480 | loss | 1705 | DPP6 | N | 0 | 67 | 109.38 | Intron+ve, ASD > 4, Normals < 2, no Sanger filter applied |
| 7 | 166 | 154028650 | 154032130 | 3,480 | gain | 1708 | DPP6 | N | 0 | 67 | 109.38 | Intron+ve, ASD > 4, Normals < 2, no Sanger filter applied |
| 7 | 166 | 154028650 | 154032130 | 3,480 | gain | 1717 | DPP6 | N | 0 | 67 | 109.38 | Intron+ve, ASD > 4, Normals < 2, no Sanger filter applied |
| 7 | 166 | 154028650 | 154032130 | 3,480 | loss | 1725 | DPP6 | N | 0 | 67 | 109.38 | Intron+ve, ASD > 4, Normals < 2, no Sanger filter applied |
| 7 | 166 | 154028650 | 154032130 | 3,480 | gain | 1730 | DPP6 | N | 0 | 67 | 109.38 | Intron+ve, ASD > 4, Normals < 2, no Sanger filter applied |
| 7 | 166 | 154028650 | 154032130 | 3,480 | loss | 1732 | DPP6 | N | 0 | 67 | 109.38 | Intron+ve, ASD > 4, Normals < 2, no Sanger filter applied |
| 7 | 166 | 154028650 | 154032130 | 3,480 | loss | 1738 | DPP6 | N | 0 | 67 | 109.38 | Intron+ve, ASD > 4, Normals < 2, no Sanger filter applied |
| 7 | 166 | 154028650 | 154032130 | 3,480 | loss | 1740 | DPP6 | N | 0 | 67 | 109.38 | Intron+ve, ASD > 4, Normals < 2, no Sanger filter applied |
| 7 | 166 | 154028650 | 154032130 | 3,480 | loss | 1743 | DPP6 | N | 0 | 67 | 109.38 | Intron+ve, ASD > 4, Normals < 2, no Sanger filter applied |
| 7 | 166 | 154028650 | 154032130 | 3,480 | loss | 1784 | DPP6 | N | 0 | 67 | 109.38 | Intron+ve, ASD > 4, Normals < 2, no Sanger filter applied |
| 7 | 166 | 154028650 | 154032130 | 3,480 | loss | 1787 | DPP6 | N | 0 | 67 | 109.38 | Intron+ve, ASD > 4, Normals < 2, no Sanger filter applied |
| 7 | 166 | 154028650 | 154032130 | 3,480 | loss | 1802 | DPP6 | N | 0 | 67 | 109.38 | Intron+ve, ASD > 4, Normals < 2, no Sanger filter applied |
| 7 | 166 | 154028650 | 154032130 | 3,480 | gain | 1808 | DPP6 | N | 0 | 67 | 109.38 | Intron+ve, ASD > 4, Normals < 2, no Sanger filter applied |
| 7 | 166 | 154028650 | 154032130 | 3,480 | gain | 1809 | DPP6 | N | 0 | 67 | 109.38 | Intron+ve, ASD > 4, Normals < 2, no Sanger filter applied |
| 7 | 166 | 154028650 | 154032130 | 3,480 | loss | 1814 | DPP6 | N | 0 | 67 | 109.38 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 7 | 166 | 154028650 | 154032130 | 3,480 | gain | 1828 | DPP6 | N | 0 | 67 | 109.38 | Intron+ve, ASD > 4, Normals < 2, no Sanger filter applied |
| 7 | 166 | 154028650 | 154032130 | 3,480 | gain | 1833 | DPP6 | N | 0 | 67 | 109.38 | Intron+ve, ASD > 4, Normals < 2, no Sanger filter applied |
| 7 | 166 | 154028650 | 154032130 | 3,480 | gain | 1844 | DPP6 | N | 0 | 67 | 109.38 | Intron+ve, ASD > 4, Normals < 2, no Sanger filter applied |
| 7 | 166 | 154028650 | 154032130 | 3,480 | loss | 1853 | DPP6 | N | 0 | 67 | 109.38 | Intron+ve, ASD > 4, Normals < 2, no Sanger filter applied |
| 7 | 166 | 154028650 | 154032130 | 3,480 | loss | 1854 | DPP6 | N | 0 | 67 | 109.38 | Intron+ve, ASD > 4, Normals < 2, no Sanger filter applied |
| 7 | 166 | 154028650 | 154032130 | 3,480 | loss | 1867 | DPP6 | N | 0 | 67 | 109.38 | Intron+ve, ASD > 4, Normals < 2, no Sanger filter applied |
| 7 | 166 | 154028650 | 154032130 | 3,480 | gain | 1871 | DPP6 | N | 0 | 67 | 109.38 | Intron+ve, ASD > 4, Normals < 2, no Sanger filter applied |
| 7 | 166 | 154028650 | 154032130 | 3,480 | loss | 1881 | DPP6 | N | 0 | 67 | 109.38 | Intron+ve, ASD > 4, Normals < 2, no Sanger filter applied |
| 7 | 166 | 154028650 | 154032130 | 3,480 | gain | 1888 | DPP6 | N | 0 | 67 | 109.38 | Intron+ve, ASD > 4, Normals < 2, no Sanger filter applied |
| 7 | 166 | 154028650 | 154032130 | 3,480 | loss | 1900 | DPP6 | N | 0 | 67 | 109.38 | Intron+ve, ASD > 4, Normals < 2, no Sanger filter applied |
| 7 | 166 | 154028650 | 154032130 | 3,480 | gain | 1931 | DPP6 | N | 0 | 67 | 109.38 | Intron+ve, ASD > 4, Normals < 2, no Sanger filter applied |
| 7 | 166 | 154028650 | 154032130 | 3,480 | loss | 1937 | DPP6 | N | 0 | 67 | 109.38 | Intron+ve, ASD > 4, Normals < 2, no Sanger filter applied |
| 7 | 166 | 154028650 | 154032130 | 3,480 | gain | 1948 | DPP6 | N | 0 | 67 | 109.38 | Intron+ve, ASD > 4, Normals < 2, no Sanger filter applied |
| 8 | 167 | 2058685 | 2063253 | 4,568 | gain | 1408 | MYOM2 | Y | 1 | 2 | 2.95 | Exon+ve, 5 > ASD > 1, Normals < 2, Sanger−ve |
| 8 | 167 | 2058685 | 2063253 | 4,568 | gain | 1532 | MYOM2 | Y | 1 | 2 | 2.95 | Exon+ve, 5 > ASD > 1, Normals < 2, Sanger−ve |
| 8 | 168 | 2063254 | 2064563 | 1,309 | gain | 1408 | MYOM2 | Y | 1 | 3 | 4.44 | Exon+ve, 5 > ASD > 1, Normals < 2, Sanger−ve |
| 8 | 168 | 2063254 | 2064563 | 1,309 | gain | 1532 | MYOM2 | Y | 1 | 3 | 4.44 | Exon+ve, 5 > ASD > 1, Normals < 2, Sanger−ve |
| 8 | 168 | 2063254 | 2064563 | 1,309 | gain | 1860 | MYOM2 | Y | 1 | 3 | 4.44 | Exon+ve, 5 > ASD > 1, Normals < 2, Sanger−ve |
| 8 | 169 | 6897144 | 6901436 | 4,292 | loss | 1551 | DEFA5 | Y | 1 | 3 | 4.44 | Exon+ve, 5 > ASD > 1, Normals < 2, Sanger−ve |
| 8 | 169 | 6897144 | 6901436 | 4,292 | loss | 1572 | DEFA5 | Y | 1 | 3 | 4.44 | Exon+ve, 5 > ASD > 1, Normals < 2, Sanger−ve |
| 8 | 169 | 6897144 | 6901436 | 4,292 | gain | 1661 | DEFA5 | Y | 1 | 3 | 4.44 | Exon+ve, 5 > ASD > 1, Normals < 2, Sanger−ve |
| 8 | 170 | 6901437 | 6909486 | 8,049 | loss | 1551 | DEFA5 | Y | 1 | 2 | 2.95 | Exon+ve, 5 > ASD > 1, Normals < 2, Sanger−ve |
| 8 | 170 | 6901437 | 6909486 | 8,049 | gain | 1572 | DEFA5 | Y | 1 | 2 | 2.95 | Exon+ve, 5 > ASD > 1, Normals < 2, Sanger−ve |
| 8 | 171 | 17673968 | 17751935 | 77,967 | loss | 1528 | MTUS1 | Y | 1 | 2 | 2.95 | Exon+ve, 5 > ASD > 1, Normals < 2, Sanger−ve |
| 8 | 171 | 17673968 | 17751935 | 77,967 | gain | 1656 | MTUS1 | Y | 1 | 2 | 2.95 | Exon+ve, 5 > ASD > 1, Normals < 2, Sanger−ve |
| 8 | 172 | 17783766 | 17793450 | 9,684 | loss | 1528 | FGL1 | Y | 1 | 2 | 2.95 | Exon+ve, 5 > ASD > 1, Normals < 2, Sanger−ve |
| 8 | 172 | 17783766 | 17793450 | 9,684 | loss | 2023 | FGL1 | Y | 1 | 2 | 2.95 | Exon+ve, 5 > ASD > 1, Normals < 2, Sanger−ve |
| 8 | 173 | 25120552 | 25123024 | 2,472 | loss | 1224 | DOCK5 | N | 0 | 33 | 51.05 | Intron+ve, ASD > 4, Normals < 2, no Sanger filter applied |
| 8 | 173 | 25120552 | 25123024 | 2,472 | loss | 1229 | DOCK5 | N | 0 | 33 | 51.05 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 8 | 173 | 25120552 | 25123024 | 2,472 | loss | 1259 | DOCK5 | N | 0 | 33 | 51.05 | Intron+ve, ASD > 4, Normals < 2, no Sanger filter applied |
| 8 | 173 | 25120552 | 25123024 | 2,472 | gain | 1274 | DOCK5 | N | 0 | 33 | 51.05 | Intron+ve, ASD > 4, Normals < 2, no Sanger filter applied |
| 8 | 173 | 25120552 | 25123024 | 2,472 | loss | 1401 | DOCK5 | N | 0 | 33 | 51.05 | Intron+ve, ASD > 4, Normals < 2, no Sanger filter applied |
| 8 | 173 | 25120552 | 25123024 | 2,472 | loss | 1445 | DOCK5 | N | 0 | 33 | 51.05 | Intron+ve, ASD > 4, Normals < 2, no Sanger filter applied |
| 8 | 173 | 25120552 | 25123024 | 2,472 | loss | 1451 | DOCK5 | N | 0 | 33 | 51.05 | Intron+ve, ASD > 4, Normals < 2, no Sanger filter applied |
| 8 | 173 | 25120552 | 25123024 | 2,472 | loss | 1536 | DOCK5 | N | 0 | 33 | 51.05 | Intron+ve, ASD > 4, Normals < 2, no Sanger filter applied |
| 8 | 173 | 25120552 | 25123024 | 2,472 | loss | 1546 | DOCK5 | N | 0 | 33 | 51.05 | Intron+ve, ASD > 4, Normals < 2, no Sanger filter applied |
| 8 | 173 | 25120552 | 25123024 | 2,472 | loss | 1551 | DOCK5 | N | 0 | 33 | 51.05 | Intron+ve, ASD > 4, Normals < 2, no Sanger filter applied |
| 8 | 173 | 25120552 | 25123024 | 2,472 | gain | 1566 | DOCK5 | N | 0 | 33 | 51.05 | Intron+ve, ASD > 4, Normals < 2, no Sanger filter applied |
| 8 | 173 | 25120552 | 25123024 | 2,472 | loss | 1573 | DOCK5 | N | 0 | 33 | 51.05 | Intron+ve, ASD > 4, Normals < 2, no Sanger filter applied |
| 8 | 173 | 25120552 | 25123024 | 2,472 | loss | 1576 | DOCK5 | N | 0 | 33 | 51.05 | Intron+ve, ASD > 4, Normals < 2, no Sanger filter applied |
| 8 | 173 | 25120552 | 25123024 | 2,472 | loss | 1592 | DOCK5 | N | 0 | 33 | 51.05 | Intron+ve, ASD > 4, Normals < 2, no Sanger filter applied |
| 8 | 173 | 25120552 | 25123024 | 2,472 | loss | 1593 | DOCK5 | N | 0 | 33 | 51.05 | Intron+ve, ASD > 4, Normals < 2, no Sanger filter applied |
| 8 | 173 | 25120552 | 25123024 | 2,472 | loss | 1611 | DOCK5 | N | 0 | 33 | 51.05 | Intron+ve, ASD > 4, Normals < 2, no Sanger filter applied |
| 8 | 173 | 25120552 | 25123024 | 2,472 | loss | 1612 | DOCK5 | N | 0 | 33 | 51.05 | Intron+ve, ASD > 4, Normals < 2, no Sanger filter applied |
| 8 | 173 | 25120552 | 25123024 | 2,472 | loss | 1670 | DOCK5 | N | 0 | 33 | 51.05 | Intron+ve, ASD > 4, Normals < 2, no Sanger filter applied |
| 8 | 173 | 25120552 | 25123024 | 2,472 | loss | 1676 | DOCK5 | N | 0 | 33 | 51.05 | Intron+ve, ASD > 4, Normals < 2, no Sanger filter applied |
| 8 | 173 | 25120552 | 25123024 | 2,472 | loss | 1687 | DOCK5 | N | 0 | 33 | 51.05 | Intron+ve, ASD > 4, Normals < 2, no Sanger filter applied |
| 8 | 173 | 25120552 | 25123024 | 2,472 | loss | 1732 | DOCK5 | N | 0 | 33 | 51.05 | Intron+ve, ASD > 4, Normals < 2, no Sanger filter applied |
| 8 | 173 | 25120552 | 25123024 | 2,472 | loss | 1738 | DOCK5 | N | 0 | 33 | 51.05 | Intron+ve, ASD > 4, Normals < 2, no Sanger filter applied |
| 8 | 173 | 25120552 | 25123024 | 2,472 | loss | 1739 | DOCK5 | N | 0 | 33 | 51.05 | Intron+ve, ASD > 4, Normals < 2, no Sanger filter applied |
| 8 | 173 | 25120552 | 25123024 | 2,472 | loss | 1740 | DOCK5 | N | 0 | 33 | 51.05 | Intron+ve, ASD > 4, Normals < 2, no Sanger filter applied |
| 8 | 173 | 25120552 | 25123024 | 2,472 | loss | 1741 | DOCK5 | N | 0 | 33 | 51.05 | Intron+ve, ASD > 4, Normals < 2, no Sanger filter applied |
| 8 | 173 | 25120552 | 25123024 | 2,472 | loss | 1764 | DOCK5 | N | 0 | 33 | 51.05 | Intron+ve, ASD > 4, Normals < 2, no Sanger filter applied |
| 8 | 173 | 25120552 | 25123024 | 2,472 | loss | 1798 | DOCK5 | N | 0 | 33 | 51.05 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 8 | 173 | 25120552 | 25123024 | 2,472 | loss | 1848 | DOCK5 | N | 0 | 33 | 51.05 | Intron+ve, ASD > 4, Normals < 2, no Sanger filter applied |
| 8 | 173 | 25120552 | 25123024 | 2,472 | loss | 1867 | DOCK5 | N | 0 | 33 | 51.05 | Intron+ve, ASD > 4, Normals < 2, no Sanger filter applied |
| 8 | 173 | 25120552 | 25123024 | 2,472 | loss | 1880 | DOCK5 | N | 0 | 33 | 51.05 | Intron+ve, ASD > 4, Normals < 2, no Sanger filter applied |
| 8 | 173 | 25120552 | 25123024 | 2,472 | loss | 1881 | DOCK5 | N | 0 | 33 | 51.05 | Intron+ve, ASD > 4, Normals < 2, no Sanger filter applied |
| 8 | 173 | 25120552 | 25123024 | 2,472 | loss | 1899 | DOCK5 | N | 0 | 33 | 51.05 | Intron+ve, ASD > 4, Normals < 2, no Sanger filter applied |
| 8 | 173 | 25120552 | 25123024 | 2,472 | loss | 2000 | DOCK5 | N | 0 | 33 | 51.05 | Intron+ve, ASD > 4, Normals < 2, no Sanger filter applied |
| 8 | 174 | 31655933 | 31663317 | 7,384 | gain | 1274 | NRG1 | N | 0 | 1 | 14.94 | Genic (distinct CNV-subregions); OR > 6 |
| 8 | 175 | 31811829 | 31814233 | 2,404 | loss | 1477 | NRG1 | N | 0 | 1 | 14.94 | Genic (distinct CNV-subregions); OR > 6 |
| 8 | 176 | 31814234 | 31815721 | 1,487 | loss | 1402 | NRG1 | N | 0 | 2 | 14.94 | Genic (distinct CNV-subregions); OR > 6 |
| 8 | 176 | 31814234 | 31815721 | 1,487 | loss | 1477 | NRG1 | N | 0 | 2 | 14.94 | Genic (distinct CNV-subregions); OR > 6 |
| 8 | 177 | 32113808 | 32143952 | 30,144 | loss | 1900 | NRG1 | N | 0 | 1 | 14.94 | Genic (distinct CNV-subregions); OR > 6 |
| 8 | 178 | 32143953 | 32148168 | 4,215 | loss | 1844 | NRG1 | N | 0 | 2 | 14.94 | Genic (distinct CNV-subregions); OR > 6 |
| 8 | 178 | 32143953 | 32148168 | 4,215 | loss | 1900 | NRG1 | N | 0 | 2 | 14.94 | Genic (distinct CNV-subregions); OR > 6 |
| 8 | 179 | 32148170 | 32148230 | 60 | gain | 1707 | NRG1 | N | 0 | 2 | 14.94 | Genic (distinct CNV-subregions); OR > 6 |
| 8 | 179 | 32148170 | 32148230 | 60 | loss | 1900 | NRG1 | N | 0 | 2 | 14.94 | Genic (distinct CNV-subregions); OR > 6 |
| 8 | 180 | 32148231 | 32180056 | 31,825 | loss | 1900 | NRG1 | N | 0 | 1 | 14.94 | Genic (distinct CNV-subregions); OR > 6 |
| 8 | 181 | 32271978 | 32274487 | 2,509 | loss | 1471 | NRG1 | N | 0 | 2 | 14.94 | Genic (distinct CNV-subregions); OR > 6 |
| 8 | 181 | 32271978 | 32274487 | 2,509 | loss | 1618 | NRG1 | N | 0 | 2 | 14.94 | Genic (distinct CNV-subregions); OR > 6 |
| 8 | 181 | 32514378 | 32520956 | 6,578 | loss | 1293 | NRG1 | N | 0 | 2 | 14.94 | Genic (distinct CNV-subregions); OR > 6 |
| 8 | 181 | 32514378 | 32520956 | 6,578 | loss | 1721 | NRG1 | N | 0 | 2 | 14.94 | Genic (distinct CNV-subregions); OR > 6 |
| 8 | 182 | 39350798 | 39352360 | 1,562 | gain | 1437 | ADAM5P | Y | 0 | 9 | 13.43 | Exon+ve, ASD > 4, Normals < 2, no Sanger filter applied |
| 8 | 182 | 39350798 | 39352360 | 1,562 | gain | 1495 | ADAM5P | Y | 0 | 9 | 13.43 | Exon+ve, ASD > 4, Normals < 2, no Sanger filter applied |
| 8 | 182 | 39350798 | 39352360 | 1,562 | gain | 1535 | ADAM5P | Y | 0 | 9 | 13.43 | Exon+ve, ASD > 4, Normals < 2, no Sanger filter applied |
| 8 | 182 | 39350798 | 39352360 | 1,562 | gain | 1546 | ADAM5P | Y | 0 | 9 | 13.43 | Exon+ve, ASD > 4, Normals < 2, no Sanger filter applied |
| 8 | 182 | 39350798 | 39352360 | 1,562 | gain | 1663 | ADAM5P | Y | 0 | 9 | 13.43 | Exon+ve, ASD > 4, Normals < 2, no Sanger filter applied |
| 8 | 182 | 39350798 | 39352360 | 1,562 | gain | 1693 | ADAM5P | Y | 0 | 9 | 13.43 | Exon+ve, ASD > 4, Normals < 2, no Sanger filter applied |
| 8 | 182 | 39350798 | 39352360 | 1,562 | gain | 1700 | ADAM5P | Y | 0 | 9 | 13.43 | Exon+ve, ASD > 4, Normals < 2, no Sanger filter applied |
| 8 | 182 | 39350798 | 39352360 | 1,562 | gain | 1730 | ADAM5P | Y | 0 | 9 | 13.43 | Exon+ve, ASD > 4, Normals < 2, no Sanger filter applied |
| 8 | 182 | 39350798 | 39352360 | 1,562 | gain | 1748 | ADAM5P | Y | 0 | 9 | 13.43 | Exon+ve, ASD > 4, Normals < 2, no Sanger filter applied |
| 8 | 183 | 43315319 | 43316714 | 1,395 | gain | 1316 | POTEA | Y | 1 | 3 | 4.44 | Exon+ve, 5 > ASD > 1, Normals < 2, Sanger-ve |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 8 | 183 | 43315319 | 43316714 | 1,395 | gain | 1406 | POTEA | Y | 1 | 3 | 4.44 | Exon+ve, 5 > ASD > 1, Normals < 2, Sanger−ve |
| 8 | 183 | 43315319 | 43316714 | 1,395 | gain | 1695 | POTEA | Y | 1 | 3 | 4.44 | Exon+ve, 5 > ASD > 1, Normals < 2, Sanger−ve |
| 8 | 184 | 51389250 | 51390466 | 1,216 | loss | 1223 | SNTG1 | N | 1 | 6 | 8.91 | Intron+ve, ASD > 4, Normals < 2, no Sanger filter applied |
| 8 | 184 | 51389250 | 51390466 | 1,216 | loss | 1405 | SNTG1 | N | 1 | 6 | 8.91 | Intron+ve, ASD > 4, Normals < 2, no Sanger filter applied |
| 8 | 184 | 51389250 | 51390466 | 1,216 | loss | 1473 | SNTG1 | N | 1 | 6 | 8.91 | Intron+ve, ASD > 4, Normals < 2, no Sanger filter applied |
| 8 | 184 | 51389250 | 51390466 | 1,216 | loss | 1572 | SNTG1 | N | 1 | 6 | 8.91 | Intron+ve, ASD > 4, Normals < 2, no Sanger filter applied |
| 8 | 184 | 51389250 | 51390466 | 1,216 | loss | 1573 | SNTG1 | N | 1 | 6 | 8.91 | Intron+ve, ASD > 4, Normals < 2, no Sanger filter applied |
| 8 | 184 | 51389250 | 51390466 | 1,216 | loss | 1876 | SNTG1 | N | 1 | 6 | 8.91 | Intron+ve, ASD > 4, Normals < 2, no Sanger filter applied |
| 8 | 185 | 52426081 | 52428920 | 2,839 | loss | 1712 | PXDNL | N | 0 | 1 | 7.42 | Genic (distinct CNV-subregions); OR > 6 |
| 8 | 185 | 52428921 | 52430531 | 1,610 | loss | 1474 | PXDNL | N | 0 | 3 | 7.42 | Genic (distinct CNV-subregions); OR > 6 |
| 8 | 185 | 52428921 | 52430531 | 1,610 | loss | 1507 | PXDNL | N | 0 | 3 | 7.42 | Genic (distinct CNV-subregions); OR > 6 |
| 8 | 185 | 52428921 | 52430531 | 1,610 | loss | 1712 | PXDNL | N | 0 | 3 | 7.42 | Genic (distinct CNV-subregions); OR > 6 |
| 8 | 186 | 52684674 | 52686421 | 1,747 | loss | 1844 | PXDNL | N | 0 | 1 | 7.42 | Genic (distinct CNV-subregions); OR > 6 |
| 8 | 187 | 52749454 | 52751043 | 1,589 | loss | 1252 | PXDNL | N | 0 | 1 | 7.42 | Genic (distinct CNV-subregions); OR > 6 |
| 8 | 188 | 88382155 | 88388307 | 6,152 | loss | 1234 | CNBD1 | N | 0 | 85 | 142.95 | Intron+ve, ASD > 4, Normals < 2, no Sanger filter applied |
| 8 | 188 | 88382155 | 88388307 | 6,152 | loss | 1260 | CNBD1 | N | 0 | 85 | 142.95 | Intron+ve, ASD > 4, Normals < 2, no Sanger filter applied |
| 8 | 188 | 88382155 | 88388307 | 6,152 | loss | 1261 | CNBD1 | N | 0 | 85 | 142.95 | Intron+ve, ASD > 4, Normals < 2, no Sanger filter applied |
| 8 | 188 | 88382155 | 88388307 | 6,152 | loss | 1270 | CNBD1 | N | 0 | 85 | 142.95 | Intron+ve, ASD > 4, Normals < 2, no Sanger filter applied |
| 8 | 188 | 88382155 | 88388307 | 6,152 | loss | 1284 | CNBD1 | N | 0 | 85 | 142.95 | Intron+ve, ASD > 4, Normals < 2, no Sanger filter applied |
| 8 | 188 | 88382155 | 88388307 | 6,152 | loss | 1285 | CNBD1 | N | 0 | 85 | 142.95 | Intron+ve, ASD > 4, Normals < 2, no Sanger filter applied |
| 8 | 188 | 88382155 | 88388307 | 6,152 | loss | 1289 | CNBD1 | N | 0 | 85 | 142.95 | Intron+ve, ASD > 4, Normals < 2, no Sanger filter applied |
| 8 | 188 | 88382155 | 88388307 | 6,152 | loss | 1301 | CNBD1 | N | 0 | 85 | 142.95 | Intron+ve, ASD > 4, Normals < 2, no Sanger filter applied |
| 8 | 188 | 88382155 | 88388307 | 6,152 | loss | 1354 | CNBD1 | N | 0 | 85 | 142.95 | Intron+ve, ASD > 4, Normals < 2, no Sanger filter applied |
| 8 | 188 | 88382155 | 88388307 | 6,152 | loss | 1372 | CNBD1 | N | 0 | 85 | 142.95 | Intron+ve, ASD > 4, Normals < 2, no Sanger filter applied |
| 8 | 188 | 88382155 | 88388307 | 6,152 | loss | 1373 | CNBD1 | N | 0 | 85 | 142.95 | Intron+ve, ASD > 4, Normals < 2, no Sanger filter applied |
| 8 | 188 | 88382155 | 88388307 | 6,152 | loss | 1417 | CNBD1 | N | 0 | 85 | 142.95 | Intron+ve, ASD > 4, Normals < 2, no Sanger filter applied |
| 8 | 188 | 88382155 | 88388307 | 6,152 | loss | 1419 | CNBD1 | N | 0 | 85 | 142.95 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 8 | 188 | 88382155 | 88388307 | 6,152 | loss | 1428 | CNBD1 | N | 0 | 85 | 142.95 | Intron+ve, ASD > 4, Normals < 2, no Sanger filter applied |
| 8 | 188 | 88382155 | 88388307 | 6,152 | loss | 1433 | CNBD1 | N | 0 | 85 | 142.95 | Intron+ve, ASD > 4, Normals < 2, no Sanger filter applied |
| 8 | 188 | 88382155 | 88388307 | 6,152 | loss | 1449 | CNBD1 | N | 0 | 85 | 142.95 | Intron+ve, ASD > 4, Normals < 2, no Sanger filter applied |
| 8 | 188 | 88382155 | 88388307 | 6,152 | loss | 1451 | CNBD1 | N | 0 | 85 | 142.95 | Intron+ve, ASD > 4, Normals < 2, no Sanger filter applied |
| 8 | 188 | 88382155 | 88388307 | 6,152 | loss | 1452 | CNBD1 | N | 0 | 85 | 142.95 | Intron+ve, ASD > 4, Normals < 2, no Sanger filter applied |
| 8 | 188 | 88382155 | 88388307 | 6,152 | loss | 1477 | CNBD1 | N | 0 | 85 | 142.95 | Intron+ve, ASD > 4, Normals < 2, no Sanger filter applied |
| 8 | 188 | 88382155 | 88388307 | 6,152 | loss | 1486 | CNBD1 | N | 0 | 85 | 142.95 | Intron+ve, ASD > 4, Normals < 2, no Sanger filter applied |
| 8 | 188 | 88382155 | 88388307 | 6,152 | loss | 1509 | CNBD1 | N | 0 | 85 | 142.95 | Intron+ve, ASD > 4, Normals < 2, no Sanger filter applied |
| 8 | 188 | 88382155 | 88388307 | 6,152 | loss | 1527 | CNBD1 | N | 0 | 85 | 142.95 | Intron+ve, ASD > 4, Normals < 2, no Sanger filter applied |
| 8 | 188 | 88382155 | 88388307 | 6,152 | loss | 1533 | CNBD1 | N | 0 | 85 | 142.95 | Intron+ve, ASD > 4, Normals < 2, no Sanger filter applied |
| 8 | 188 | 88382155 | 88388307 | 6,152 | loss | 1558 | CNBD1 | N | 0 | 85 | 142.95 | Intron+ve, ASD > 4, Normals < 2, no Sanger filter applied |
| 8 | 188 | 88382155 | 88388307 | 6,152 | loss | 1561 | CNBD1 | N | 0 | 85 | 142.95 | Intron+ve, ASD > 4, Normals < 2, no Sanger filter applied |
| 8 | 188 | 88382155 | 88388307 | 6,152 | loss | 1573 | CNBD1 | N | 0 | 85 | 142.95 | Intron+ve, ASD > 4, Normals < 2, no Sanger filter applied |
| 8 | 188 | 88382155 | 88388307 | 6,152 | loss | 1576 | CNBD1 | N | 0 | 85 | 142.95 | Intron+ve, ASD > 4, Normals < 2, no Sanger filter applied |
| 8 | 188 | 88382155 | 88388307 | 6,152 | loss | 1581 | CNBD1 | N | 0 | 85 | 142.95 | Intron+ve, ASD > 4, Normals < 2, no Sanger filter applied |
| 8 | 188 | 88382155 | 88388307 | 6,152 | loss | 1595 | CNBD1 | N | 0 | 85 | 142.95 | Intron+ve, ASD > 4, Normals < 2, no Sanger filter applied |
| 8 | 188 | 88382155 | 88388307 | 6,152 | loss | 1602 | CNBD1 | N | 0 | 85 | 142.95 | Intron+ve, ASD > 4, Normals < 2, no Sanger filter applied |
| 8 | 188 | 88382155 | 88388307 | 6,152 | loss | 1609 | CNBD1 | N | 0 | 85 | 142.95 | Intron+ve, ASD > 4, Normals < 2, no Sanger filter applied |
| 8 | 188 | 88382155 | 88388307 | 6,152 | loss | 1615 | CNBD1 | N | 0 | 85 | 142.95 | Intron+ve, ASD > 4, Normals < 2, no Sanger filter applied |
| 8 | 188 | 88382155 | 88388307 | 6,152 | loss | 1621 | CNBD1 | N | 0 | 85 | 142.95 | Intron+ve, ASD > 4, Normals < 2, no Sanger filter applied |
| 8 | 188 | 88382155 | 88388307 | 6,152 | loss | 1622 | CNBD1 | N | 0 | 85 | 142.95 | Intron+ve, ASD > 4, Normals < 2, no Sanger filter applied |
| 8 | 188 | 88382155 | 88388307 | 6,152 | loss | 1629 | CNBD1 | N | 0 | 85 | 142.95 | Intron+ve, ASD > 4, Normals < 2, no Sanger filter applied |
| 8 | 188 | 88382155 | 88388307 | 6,152 | loss | 1634 | CNBD1 | N | 0 | 85 | 142.95 | Intron+ve, ASD > 4, Normals < 2, no Sanger filter applied |
| 8 | 188 | 88382155 | 88388307 | 6,152 | loss | 1638 | CNBD1 | N | 0 | 85 | 142.95 | Intron+ve, ASD > 4, Normals < 2, no Sanger filter applied |
| 8 | 188 | 88382155 | 88388307 | 6,152 | loss | 1639 | CNBD1 | N | 0 | 85 | 142.95 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 8 | 188 | 88382155 | 88388307 | 6,152 | loss | 1658 | CNBD1 | N | 0 | 85 | 142.95 | Intron+ve, ASD > 4, Normals < 2, no Sanger filter applied |
| 8 | 188 | 88382155 | 88388307 | 6,152 | loss | 1667 | CNBD1 | N | 0 | 85 | 142.95 | Intron+ve, ASD > 4, Normals < 2, no Sanger filter applied |
| 8 | 188 | 88382155 | 88388307 | 6,152 | loss | 1672 | CNBD1 | N | 0 | 85 | 142.95 | Intron+ve, ASD > 4, Normals < 2, no Sanger filter applied |
| 8 | 188 | 88382155 | 88388307 | 6,152 | loss | 1677 | CNBD1 | N | 0 | 85 | 142.95 | Intron+ve, ASD > 4, Normals < 2, no Sanger filter applied |
| 8 | 188 | 88382155 | 88388307 | 6,152 | loss | 1681 | CNBD1 | N | 0 | 85 | 142.95 | Intron+ve, ASD > 4, Normals < 2, no Sanger filter applied |
| 8 | 188 | 88382155 | 88388307 | 6,152 | loss | 1683 | CNBD1 | N | 0 | 85 | 142.95 | Intron+ve, ASD > 4, Normals < 2, no Sanger filter applied |
| 8 | 188 | 88382155 | 88388307 | 6,152 | loss | 1697 | CNBD1 | N | 0 | 85 | 142.95 | Intron+ve, ASD > 4, Normals < 2, no Sanger filter applied |
| 8 | 188 | 88382155 | 88388307 | 6,152 | loss | 1715 | CNBD1 | N | 0 | 85 | 142.95 | Intron+ve, ASD > 4, Normals < 2, no Sanger filter applied |
| 8 | 188 | 88382155 | 88388307 | 6,152 | loss | 1723 | CNBD1 | N | 0 | 85 | 142.95 | Intron+ve, ASD > 4, Normals < 2, no Sanger filter applied |
| 8 | 188 | 88382155 | 88388307 | 6,152 | loss | 1724 | CNBD1 | N | 0 | 85 | 142.95 | Intron+ve, ASD > 4, Normals < 2, no Sanger filter applied |
| 8 | 188 | 88382155 | 88388307 | 6,152 | loss | 1725 | CNBD1 | N | 0 | 85 | 142.95 | Intron+ve, ASD > 4, Normals < 2, no Sanger filter applied |
| 8 | 188 | 88382155 | 88388307 | 6,152 | loss | 1732 | CNBD1 | N | 0 | 85 | 142.95 | Intron+ve, ASD > 4, Normals < 2, no Sanger filter applied |
| 8 | 188 | 88382155 | 88388307 | 6,152 | loss | 1743 | CNBD1 | N | 0 | 85 | 142.95 | Intron+ve, ASD > 4, Normals < 2, no Sanger filter applied |
| 8 | 188 | 88382155 | 88388307 | 6,152 | loss | 1750 | CNBD1 | N | 0 | 85 | 142.95 | Intron+ve, ASD > 4, Normals < 2, no Sanger filter applied |
| 8 | 188 | 88382155 | 88388307 | 6,152 | loss | 1751 | CNBD1 | N | 0 | 85 | 142.95 | Intron+ve, ASD > 4, Normals < 2, no Sanger filter applied |
| 8 | 188 | 88382155 | 88388307 | 6,152 | loss | 1753 | CNBD1 | N | 0 | 85 | 142.95 | Intron+ve, ASD > 4, Normals < 2, no Sanger filter applied |
| 8 | 188 | 88382155 | 88388307 | 6,152 | loss | 1754 | CNBD1 | N | 0 | 85 | 142.95 | Intron+ve, ASD > 4, Normals < 2, no Sanger filter applied |
| 8 | 188 | 88382155 | 88388307 | 6,152 | loss | 1758 | CNBD1 | N | 0 | 85 | 142.95 | Intron+ve, ASD > 4, Normals < 2, no Sanger filter applied |
| 8 | 188 | 88382155 | 88388307 | 6,152 | loss | 1760 | CNBD1 | N | 0 | 85 | 142.95 | Intron+ve, ASD > 4, Normals < 2, no Sanger filter applied |
| 8 | 188 | 88382155 | 88388307 | 6,152 | loss | 1765 | CNBD1 | N | 0 | 85 | 142.95 | Intron+ve, ASD > 4, Normals < 2, no Sanger filter applied |
| 8 | 188 | 88382155 | 88388307 | 6,152 | loss | 1776 | CNBD1 | N | 0 | 85 | 142.95 | Intron+ve, ASD > 4, Normals < 2, no Sanger filter applied |
| 8 | 188 | 88382155 | 88388307 | 6,152 | loss | 1787 | CNBD1 | N | 0 | 85 | 142.95 | Intron+ve, ASD > 4, Normals < 2, no Sanger filter applied |
| 8 | 188 | 88382155 | 88388307 | 6,152 | loss | 1796 | CNBD1 | N | 0 | 85 | 142.95 | Intron+ve, ASD > 4, Normals < 2, no Sanger filter applied |
| 8 | 188 | 88382155 | 88388307 | 6,152 | loss | 1797 | CNBD1 | N | 0 | 85 | 142.95 | Intron+ve, ASD > 4, Normals < 2, no Sanger filter applied |
| 8 | 188 | 88382155 | 88388307 | 6,152 | loss | 1802 | CNBD1 | N | 0 | 85 | 142.95 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 8 | 188 | 88382155 | 88388307 | 6,152 | loss | 1807 | CNBD1 | N | 0 | 85 | 142.95 | Intron+ve, ASD > 4, Normals < 2, no Sanger filter applied |
| 8 | 188 | 88382155 | 88388307 | 6,152 | loss | 1811 | CNBD1 | N | 0 | 85 | 142.95 | Intron+ve, ASD > 4, Normals < 2, no Sanger filter applied |
| 8 | 188 | 88382155 | 88388307 | 6,152 | loss | 1814 | CNBD1 | N | 0 | 85 | 142.95 | Intron+ve, ASD > 4, Normals < 2, no Sanger filter applied |
| 8 | 188 | 88382155 | 88388307 | 6,152 | loss | 1816 | CNBD1 | N | 0 | 85 | 142.95 | Intron+ve, ASD > 4, Normals < 2, no Sanger filter applied |
| 8 | 188 | 88382155 | 88388307 | 6,152 | loss | 1822 | CNBD1 | N | 0 | 85 | 142.95 | Intron+ve, ASD > 4, Normals < 2, no Sanger filter applied |
| 8 | 188 | 88382155 | 88388307 | 6,152 | loss | 1852 | CNBD1 | N | 0 | 85 | 142.95 | Intron+ve, ASD > 4, Normals < 2, no Sanger filter applied |
| 8 | 188 | 88382155 | 88388307 | 6,152 | loss | 1859 | CNBD1 | N | 0 | 85 | 142.95 | Intron+ve, ASD > 4, Normals < 2, no Sanger filter applied |
| 8 | 188 | 88382155 | 88388307 | 6,152 | loss | 1862 | CNBD1 | N | 0 | 85 | 142.95 | Intron+ve, ASD > 4, Normals < 2, no Sanger filter applied |
| 8 | 188 | 88382155 | 88388307 | 6,152 | loss | 1864 | CNBD1 | N | 0 | 85 | 142.95 | Intron+ve, ASD > 4, Normals < 2, no Sanger filter applied |
| 8 | 188 | 88382155 | 88388307 | 6,152 | loss | 1867 | CNBD1 | N | 0 | 85 | 142.95 | Intron+ve, ASD > 4, Normals < 2, no Sanger filter applied |
| 8 | 188 | 88382155 | 88388307 | 6,152 | loss | 1870 | CNBD1 | N | 0 | 85 | 142.95 | Intron+ve, ASD > 4, Normals < 2, no Sanger filter applied |
| 8 | 188 | 88382155 | 88388307 | 6,152 | loss | 1874 | CNBD1 | N | 0 | 85 | 142.95 | Intron+ve, ASD > 4, Normals < 2, no Sanger filter applied |
| 8 | 188 | 88382155 | 88388307 | 6,152 | loss | 1900 | CNBD1 | N | 0 | 85 | 142.95 | Intron+ve, ASD > 4, Normals < 2, no Sanger filter applied |
| 8 | 188 | 88382155 | 88388307 | 6,152 | loss | 1901 | CNBD1 | N | 0 | 85 | 142.95 | Intron+ve, ASD > 4, Normals < 2, no Sanger filter applied |
| 8 | 188 | 88382155 | 88388307 | 6,152 | loss | 1908 | CNBD1 | N | 0 | 85 | 142.95 | Intron+ve, ASD > 4, Normals < 2, no Sanger filter applied |
| 8 | 188 | 88382155 | 88388307 | 6,152 | loss | 1923 | CNBD1 | N | 0 | 85 | 142.95 | Intron+ve, ASD > 4, Normals < 2, no Sanger filter applied |
| 8 | 188 | 88382155 | 88388307 | 6,152 | loss | 1926 | CNBD1 | N | 0 | 85 | 142.95 | Intron+ve, ASD > 4, Normals < 2, no Sanger filter applied |
| 8 | 188 | 88382155 | 88388307 | 6,152 | loss | 1927 | CNBD1 | N | 0 | 85 | 142.95 | Intron+ve, ASD > 4, Normals < 2, no Sanger filter applied |
| 8 | 188 | 88382155 | 88388307 | 6,152 | loss | 1929 | CNBD1 | N | 0 | 85 | 142.95 | Intron+ve, ASD > 4, Normals < 2, no Sanger filter applied |
| 8 | 188 | 88382155 | 88388307 | 6,152 | loss | 1945 | CNBD1 | N | 0 | 85 | 142.95 | Intron+ve, ASD > 4, Normals < 2, no Sanger filter applied |
| 8 | 188 | 88382155 | 88388307 | 6,152 | loss | 1996 | CNBD1 | N | 0 | 85 | 142.95 | Intron+ve, ASD > 4, Normals < 2, no Sanger filter applied |
| 8 | 188 | 88382155 | 88388307 | 6,152 | loss | 2028 | CNBD1 | N | 0 | 85 | 142.95 | Intron+ve, ASD > 4, Normals < 2, no Sanger filter applied |
| 8 | 189 | 95219409 | 95219512 | 103 | gain | 1282 | CDH17 | N | 0 | 11 | 16.46 | Intron+ve, ASD > 4, Normals < 2, no Sanger filter applied |
| 8 | 189 | 95219409 | 95219512 | 103 | gain | 1306 | CDH17 | N | 0 | 11 | 16.46 | Intron+ve, ASD > 4, Normals < 2, no Sanger filter applied |
| 8 | 189 | 95219409 | 95219512 | 103 | gain | 1308 | CDH17 | N | 0 | 11 | 16.46 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 8 | 189 | 95219409 | 95219512 | 103 | gain | 1394 | CDH17 | N | 0 | 11 | 16.46 | Intron+ve, ASD > 4, Normals < 2, no Sanger filter applied |
| 8 | 189 | 95219409 | 95219512 | 103 | gain | 1567 | CDH17 | N | 0 | 11 | 16.46 | Intron+ve, ASD > 4, Normals < 2, no Sanger filter applied |
| 8 | 189 | 95219409 | 95219512 | 103 | gain | 1601 | CDH17 | N | 0 | 11 | 16.46 | Intron+ve, ASD > 4, Normals < 2, no Sanger filter applied |
| 8 | 189 | 95219409 | 95219512 | 103 | gain | 1619 | CDH17 | N | 0 | 11 | 16.46 | Intron+ve, ASD > 4, Normals < 2, no Sanger filter applied |
| 8 | 189 | 95219409 | 95219512 | 103 | gain | 1640 | CDH17 | N | 0 | 11 | 16.46 | Intron+ve, ASD > 4, Normals < 2, no Sanger filter applied |
| 8 | 189 | 95219409 | 95219512 | 103 | gain | 1677 | CDH17 | N | 0 | 11 | 16.46 | Intron+ve, ASD > 4, Normals < 2, no Sanger filter applied |
| 8 | 189 | 95219409 | 95219512 | 103 | gain | 1708 | CDH17 | N | 0 | 11 | 16.46 | Intron+ve, ASD > 4, Normals < 2, no Sanger filter applied |
| 8 | 189 | 95219409 | 95219512 | 103 | gain | 1928 | CDH17 | N | 0 | 11 | 16.46 | Intron+ve, ASD > 4, Normals < 2, no Sanger filter applied |
| 8 | 190 | 95219514 | 95219587 | 73 | gain | 1274 | CDH17 | N | 0 | 15 | 22.58 | Intron+ve, ASD > 4, Normals < 2, no Sanger filter applied |
| 8 | 190 | 95219514 | 95219587 | 73 | gain | 1306 | CDH17 | N | 0 | 15 | 22.58 | Intron+ve, ASD > 4, Normals < 2, no Sanger filter applied |
| 8 | 190 | 95219514 | 95219587 | 73 | gain | 1308 | CDH17 | N | 0 | 15 | 22.58 | Intron+ve, ASD > 4, Normals < 2, no Sanger filter applied |
| 8 | 190 | 95219514 | 95219587 | 73 | gain | 1389 | CDH17 | N | 0 | 15 | 22.58 | Intron+ve, ASD > 4, Normals < 2, no Sanger filter applied |
| 8 | 190 | 95219514 | 95219587 | 73 | gain | 1394 | CDH17 | N | 0 | 15 | 22.58 | Intron+ve, ASD > 4, Normals < 2, no Sanger filter applied |
| 8 | 190 | 95219514 | 95219587 | 73 | gain | 1449 | CDH17 | N | 0 | 15 | 22.58 | Intron+ve, ASD > 4, Normals < 2, no Sanger filter applied |
| 8 | 190 | 95219514 | 95219587 | 73 | gain | 1619 | CDH17 | N | 0 | 15 | 22.58 | Intron+ve, ASD > 4, Normals < 2, no Sanger filter applied |
| 8 | 190 | 95219514 | 95219587 | 73 | gain | 1640 | CDH17 | N | 0 | 15 | 22.58 | Intron+ve, ASD > 4, Normals < 2, no Sanger filter applied |
| 8 | 190 | 95219514 | 95219587 | 73 | loss | 1643 | CDH17 | N | 0 | 15 | 22.58 | Intron+ve, ASD > 4, Normals < 2, no Sanger filter applied |
| 8 | 190 | 95219514 | 95219587 | 73 | gain | 1661 | CDH17 | N | 0 | 15 | 22.58 | Intron+ve, ASD > 4, Normals < 2, no Sanger filter applied |
| 8 | 190 | 95219514 | 95219587 | 73 | gain | 1677 | CDH17 | N | 0 | 15 | 22.58 | Intron+ve, ASD > 4, Normals < 2, no Sanger filter applied |
| 8 | 190 | 95219514 | 95219587 | 73 | gain | 1708 | CDH17 | N | 0 | 15 | 22.58 | Intron+ve, ASD > 4, Normals < 2, no Sanger filter applied |
| 8 | 190 | 95219514 | 95219587 | 73 | gain | 1814 | CDH17 | N | 0 | 15 | 22.58 | Intron+ve, ASD > 4, Normals < 2, no Sanger filter applied |
| 8 | 190 | 95219514 | 95219587 | 73 | gain | 1853 | CDH17 | N | 0 | 15 | 22.58 | Intron+ve, ASD > 4, Normals < 2, no Sanger filter applied |
| 8 | 190 | 95219514 | 95219587 | 73 | gain | 1893 | CDH17 | N | 0 | 15 | 22.58 | Intron+ve, ASD > 4, Normals < 2, no Sanger filter applied |
| 8 | 191 | 107368178 | 107369802 | 1,624 | loss | 1306 | OXR1 | N | 2 | 2 | 6.71 | Genic (distinct CNV-subregions); OR > 6 |
| 8 | 191 | 107368178 | 107369802 | 1,624 | loss | 1619 | OXR1 | N | 2 | 2 | 6.71 | Genic (distinct CNV-subregions); OR > 6 |
| 8 | 192 | 107605521 | 107616812 | 11,291 | gain | 1464 | OXR1 | N | 0 | 3 | 6.71 | Genic (distinct CNV-subregions); OR > 6 |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 8 | 192 | 107605521 | 107616812 | 11,291 | gain | 1519 | OXR1 | N | 0 | 3 | 6.71 | Genic (distinct CNV-subregions); OR > 6 |
| 8 | 192 | 107605521 | 107616812 | 11,291 | gain | 1723 | OXR1 | N | 0 | 3 | 6.71 | Genic (distinct CNV-subregions); OR > 6 |
| 8 | 193 | 107697816 | 107699245 | 1,429 | gain | 1373 | OXR1 | N | 0 | 3 | 6.71 | Genic (distinct CNV-subregions); OR > 6 |
| 8 | 193 | 107697816 | 107699245 | 1,429 | gain | 1872 | OXR1 | N | 0 | 3 | 6.71 | Genic (distinct CNV-subregions); OR > 6 |
| 8 | 193 | 107697816 | 107699245 | 1,429 | gain | 1946 | OXR1 | N | 0 | 3 | 6.71 | Genic (distinct CNV-subregions); OR > 6 |
| 8 | 194 | 107699246 | 107701550 | 2,304 | gain | 1872 | OXR1 | N | 0 | 2 | 6.71 | Genic (distinct CNV-subregions); OR > 6 |
| 8 | 194 | 107699246 | 107701550 | 2,304 | gain | 1946 | OXR1 | N | 0 | 2 | 6.71 | Genic (distinct CNV-subregions); OR > 6 |
| 8 | 195 | 107737273 | 107739119 | 1,846 | loss | 1574 | OXR1 | N | 0 | 1 | 6.71 | Genic (distinct CNV-subregions); OR > 6 |
| 8 | 196 | 114414403 | 114415656 | 1,253 | loss | 1848 | CSMD3 | N | 0 | 16 | 24.12 | Intron+ve, ASD > 4, Normals < 2, no Sanger filter applied |
| 8 | 196 | 114414403 | 114415656 | 1,253 | loss | 1851 | CSMD3 | N | 0 | 16 | 24.12 | Intron+ve, ASD > 4, Normals < 2, no Sanger filter applied |
| 8 | 196 | 114414403 | 114415656 | 1,253 | loss | 1855 | CSMD3 | N | 0 | 16 | 24.12 | Intron+ve, ASD > 4, Normals < 2, no Sanger filter applied |
| 8 | 196 | 114414403 | 114415656 | 1,253 | loss | 1871 | CSMD3 | N | 0 | 16 | 24.12 | Intron+ve, ASD > 4, Normals < 2, no Sanger filter applied |
| 8 | 196 | 114414403 | 114415656 | 1,253 | loss | 1876 | CSMD3 | N | 0 | 16 | 24.12 | Intron+ve, ASD > 4, Normals < 2, no Sanger filter applied |
| 8 | 196 | 114414403 | 114415656 | 1,253 | loss | 1878 | CSMD3 | N | 0 | 16 | 24.12 | Intron+ve, ASD > 4, Normals < 2, no Sanger filter applied |
| 8 | 196 | 114414403 | 114415656 | 1,253 | loss | 1897 | CSMD3 | N | 0 | 16 | 24.12 | Intron+ve, ASD > 4, Normals < 2, no Sanger filter applied |
| 8 | 196 | 114414403 | 114415656 | 1,253 | loss | 1902 | CSMD3 | N | 0 | 16 | 24.12 | Intron+ve, ASD > 4, Normals < 2, no Sanger filter applied |
| 8 | 196 | 114414403 | 114415656 | 1,253 | loss | 1916 | CSMD3 | N | 0 | 16 | 24.12 | Intron+ve, ASD > 4, Normals < 2, no Sanger filter applied |
| 8 | 196 | 114414403 | 114415656 | 1,253 | loss | 1918 | CSMD3 | N | 0 | 16 | 24.12 | Intron+ve, ASD > 4, Normals < 2, no Sanger filter applied |
| 8 | 196 | 114414403 | 114415656 | 1,253 | loss | 1921 | CSMD3 | N | 0 | 16 | 24.12 | Intron+ve, ASD > 4, Normals < 2, no Sanger filter applied |
| 8 | 196 | 114414403 | 114415656 | 1,253 | loss | 1935 | CSMD3 | N | 0 | 16 | 24.12 | Intron+ve, ASD > 4, Normals < 2, no Sanger filter applied |
| 8 | 196 | 114414403 | 114415656 | 1,253 | loss | 1953 | CSMD3 | N | 0 | 16 | 24.12 | Intron+ve, ASD > 4, Normals < 2, no Sanger filter applied |
| 8 | 196 | 114414403 | 114415656 | 1,253 | loss | 1969 | CSMD3 | N | 0 | 16 | 24.12 | Intron+ve, ASD > 4, Normals < 2, no Sanger filter applied |
| 8 | 196 | 114414403 | 114415656 | 1,253 | loss | 1988 | CSMD3 | N | 0 | 16 | 24.12 | Intron+ve, ASD > 4, Normals < 2, no Sanger filter applied |
| 8 | 196 | 114414403 | 114415656 | 1,253 | loss | 2031 | CSMD3 | N | 0 | 16 | 24.12 | Intron+ve, ASD > 4, Normals < 2, no Sanger filter applied |
| 9 | 197 | 19415150 | 19434760 | 19,610 | gain | 1297 | ACER2 | Y | 1 | 2 | 2.95 | Exon+ve, 5 > ASD > 1, Normals < 2, Sanger-ve |
| 9 | 197 | 19415150 | 19434760 | 19,610 | gain | 1418 | ACER2 | Y | 1 | 2 | 2.95 | Exon+ve, 5 > ASD > 1, Normals < 2, Sanger-ve |
| 9 | 198 | 21250372 | 21267945 | 17,573 | loss | 1418 | IFNA22P | Y | 1 | 6 | 8.91 | Exon+ve, ASD > 4, Normals < 2, no Sanger filter applied |
| 9 | 198 | 21250372 | 21267945 | 17,573 | gain | 1432 | IFNA22P | Y | 1 | 6 | 8.91 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 9 | 198 | 21250372 | 21267945 | 17,573 | gain | 1485 | IFNA22P | Y | 1 | 6 | 8.91 | Exon+ve, ASD > 4, Normals < 2, no Sanger filter applied |
| 9 | 198 | 21250372 | 21267945 | 17,573 | gain | 1615 | IFNA22P | Y | 1 | 6 | 8.91 | Exon+ve, ASD > 4, Normals < 2, no Sanger filter applied |
| 9 | 198 | 21250372 | 21267945 | 17,573 | gain | 1798 | IFNA22P | Y | 1 | 6 | 8.91 | Exon+ve, ASD > 4, Normals < 2, no Sanger filter applied |
| 9 | 198 | 21250372 | 21267945 | 17,573 | gain | 2020 | IFNA22P | Y | 1 | 6 | 8.91 | Exon+ve, ASD > 4, Normals < 2, no Sanger filter applied |
| 9 | 199 | 28541438 | 28548817 | 7,379 | loss | 1309 | LINGO2 | N | 0 | 6 | 8.91 | Intron+ve, ASD > 4, Normals < 2, no Sanger filter applied |
| 9 | 199 | 28541438 | 28548817 | 7,379 | gain | 1530 | LINGO2 | N | 0 | 6 | 8.91 | Intron+ve, ASD > 4, Normals < 2, no Sanger filter applied |
| 9 | 199 | 28541438 | 28548817 | 7,379 | gain | 1585 | LINGO2 | N | 0 | 6 | 8.91 | Intron+ve, ASD > 4, Normals < 2, no Sanger filter applied |
| 9 | 199 | 28541438 | 28548817 | 7,379 | gain | 1606 | LINGO2 | N | 0 | 6 | 8.91 | Intron+ve, ASD > 4, Normals < 2, no Sanger filter applied |
| 9 | 199 | 28541438 | 28548817 | 7,379 | loss | 1820 | LINGO2 | N | 0 | 6 | 8.91 | Intron+ve, ASD > 4, Normals < 2, no Sanger filter applied |
| 9 | 199 | 28541438 | 28548817 | 7,379 | loss | 1988 | LINGO2 | N | 0 | 6 | 8.91 | Intron+ve, ASD > 4, Normals < 2, no Sanger filter applied |
| 9 | 200 | 71224527 | 71239115 | 14,588 | gain | 1558 | APBA1 | Y | 1 | 5 | 7.42 | Exon+ve, ASD > 4, Normals < 2, no Sanger filter applied |
| 9 | 200 | 71224527 | 71239115 | 14,588 | loss | 1639 | APBA1 | Y | 1 | 5 | 7.42 | Exon+ve, ASD > 4, Normals < 2, no Sanger filter applied |
| 9 | 200 | 71224527 | 71239115 | 14,588 | gain | 1829 | APBA1 | Y | 1 | 5 | 7.42 | Exon+ve, ASD > 4, Normals < 2, no Sanger filter applied |
| 9 | 200 | 71224527 | 71239115 | 14,588 | gain | 1904 | APBA1 | Y | 1 | 5 | 7.42 | Exon+ve, ASD > 4, Normals < 2, no Sanger filter applied |
| 9 | 200 | 71224527 | 71239115 | 14,588 | gain | 1970 | APBA1 | Y | 1 | 5 | 7.42 | Exon+ve, ASD > 4, Normals < 2, no Sanger filter applied |
| 9 | 201 | 73775988 | 73777413 | 1,425 | gain | 1268 | C9orf85 | Y | 1 | 5 | 7.42 | Exon+ve, ASD > 4, Normals < 2, no Sanger filter applied |
| 9 | 201 | 73775988 | 73777413 | 1,425 | gain | 1793 | C9orf85 | Y | 1 | 5 | 7.42 | Exon+ve, ASD > 4, Normals < 2, no Sanger filter applied |
| 9 | 201 | 73775988 | 73777413 | 1,425 | gain | 1855 | C9orf85 | Y | 1 | 5 | 7.42 | Exon+ve, ASD > 4, Normals < 2, no Sanger filter applied |
| 9 | 201 | 73775988 | 73777413 | 1,425 | gain | 1883 | C9orf85 | Y | 1 | 5 | 7.42 | Exon+ve, ASD > 4, Normals < 2, no Sanger filter applied |
| 9 | 201 | 73775988 | 73777413 | 1,425 | gain | 1893 | C9orf85 | Y | 1 | 5 | 7.42 | Exon+ve, ASD > 4, Normals < 2, no Sanger filter applied |
| 9 | 202 | 79037750 | 79047245 | 9,495 | gain | 1589 | VPS13A | Y | 1 | 4 | 5.92 | Exon+ve, 5 > ASD > 1, Normals < 2, Sanger-ve |
| 9 | 202 | 79037750 | 79047245 | 9,495 | gain | 1782 | VPS13A | Y | 1 | 4 | 5.92 | Exon+ve, 5 > ASD > 1, Normals < 2, Sanger-ve |
| 9 | 202 | 79037750 | 79047245 | 9,495 | gain | 1897 | VPS13A | Y | 1 | 4 | 5.92 | Exon+ve, 5 > ASD > 1, Normals < 2, Sanger-ve |
| 9 | 202 | 79037750 | 79047245 | 9,495 | gain | 1938 | VPS13A | Y | 1 | 4 | 5.92 | Exon+ve, 5 > ASD > 1, Normals < 2, Sanger-ve |
| 9 | 203 | 97693397 | 97692568 | 1,871 | loss | 1426 | C9orf102 | N | 0 | 5 | 7.42 | Intron+ve, ASD > 4, Normals < 2, no Sanger filter applied |
| 9 | 203 | 97693397 | 97692568 | 1,871 | loss | 1442 | C9orf102 | N | 0 | 5 | 7.42 | Intron+ve, ASD > 4, Normals < 2, no Sanger filter applied |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 9 | 203 | 97693397 | 97692568 | 1,871 | loss | 1552 | C9orf102 | N | 0 | 5 | 7.42 | Intron+ve, ASD > 4, Normals < 2, no Sanger filter applied |
| 9 | 203 | 97693397 | 97692568 | 1,871 | loss | 1580 | C9orf102 | N | 0 | 5 | 7.42 | Intron+ve, ASD > 4, Normals < 2, no Sanger filter applied |
| 9 | 203 | 97693397 | 97692568 | 1,871 | loss | 1996 | C9orf102 | N | 0 | 5 | 7.42 | Intron+ve, ASD > 4, Normals < 2, no Sanger filter applied |
| 9 | 204 | 107567322 | 107567415 | 93 | loss | 1308 | TMEM38B | N | 1 | 6 | 8.91 | Intron+ve, ASD > 4, Normals < 2, no Sanger filter applied |
| 9 | 204 | 107567322 | 107567415 | 93 | loss | 1502 | TMEM38B | N | 1 | 6 | 8.91 | Intron+ve, ASD > 4, Normals < 2, no Sanger filter applied |
| 9 | 204 | 107567322 | 107567415 | 93 | loss | 1555 | TMEM38B | N | 1 | 6 | 8.91 | Intron+ve, ASD > 4, Normals < 2, no Sanger filter applied |
| 9 | 204 | 107567322 | 107567415 | 93 | loss | 1563 | TMEM38B | N | 1 | 6 | 8.91 | Intron+ve, ASD > 4, Normals < 2, no Sanger filter applied |
| 9 | 204 | 107567322 | 107567415 | 93 | gain | 1611 | TMEM38B | N | 1 | 6 | 8.91 | Intron+ve, ASD > 4, Normals < 2, no Sanger filter applied |
| 9 | 204 | 107567322 | 107567415 | 93 | loss | 1876 | TMEM38B | N | 1 | 6 | 8.91 | Intron+ve, ASD > 4, Normals < 2, no Sanger filter applied |
| 9 | 205 | 111606594 | 111609721 | 3,127 | loss | 1227 | PALM2-AKAP2, PALM2 | N | 1 | 7 | 10.41 | Intron+ve, ASD > 4, Normals < 2, no Sanger filter applied |
| 9 | 205 | 111606594 | 111609721 | 3,127 | loss | 1475 | PALM2-AKAP2, PALM2 | N | 1 | 7 | 10.41 | Intron+ve, ASD > 4, Normals < 2, no Sanger filter applied |
| 9 | 205 | 111606594 | 111609721 | 3,127 | loss | 1621 | PALM2-AKAP2, PALM2 | N | 1 | 7 | 10.41 | Intron+ve, ASD > 4, Normals < 2, no Sanger filter applied |
| 9 | 205 | 111606594 | 111609721 | 3,127 | loss | 1670 | PALM2-AKAP2, PALM2 | N | 1 | 7 | 10.41 | Intron+ve, ASD > 4, Normals < 2, no Sanger filter applied |
| 9 | 205 | 111606594 | 111609721 | 3,127 | loss | 1805 | PALM2-AKAP2, PALM2 | N | 1 | 7 | 10.41 | Intron+ve, ASD > 4, Normals < 2, no Sanger filter applied |
| 9 | 205 | 111606594 | 111609721 | 3,127 | loss | 1854 | PALM2-AKAP2, PALM2 | N | 1 | 7 | 10.41 | Intron+ve, ASD > 4, Normals < 2, no Sanger filter applied |
| 9 | 205 | 111606594 | 111609721 | 3,127 | loss | 1878 | PALM2-AKAP2, PALM2 | N | 1 | 7 | 10.41 | Intron+ve, ASD > 4, Normals < 2, no Sanger filter applied |
| 9 | 206 | 111609723 | 111613988 | 4,265 | loss | 1420 | PALM2-AKAP2, PALM2 | N | 0 | 7 | 10.41 | Intron+ve, ASD > 4, Normals < 2, no Sanger filter applied |
| 9 | 206 | 111609723 | 111613988 | 4,265 | loss | 1475 | PALM2-AKAP2, PALM2 | N | 0 | 7 | 10.41 | Intron+ve, ASD > 4, Normals < 2, no Sanger filter applied |
| 9 | 206 | 111609723 | 111613988 | 4,265 | loss | 1516 | PALM2-AKAP2, PALM2 | N | 0 | 7 | 10.41 | Intron+ve, ASD > 4, Normals < 2, no Sanger filter applied |
| 9 | 206 | 111609723 | 111613988 | 4,265 | gain | 1680 | PALM2-AKAP2, PALM2 | N | 0 | 7 | 10.41 | Intron+ve, ASD > 4, Normals < 2, no Sanger filter applied |
| 9 | 206 | 111609723 | 111613988 | 4,265 | loss | 1805 | PALM2-AKAP2, PALM2 | N | 0 | 7 | 10.41 | Intron+ve, ASD > 4, Normals < 2, no Sanger filter applied |
| 9 | 206 | 111609723 | 111613988 | 4,265 | loss | 1878 | PALM2-AKAP2, PALM2 | N | 0 | 7 | 10.41 | Intron+ve, ASD > 4, Normals < 2, no Sanger filter applied |
| 9 | 206 | 111609723 | 111613988 | 4,265 | loss | 1893 | PALM2-AKAP2, PALM2 | N | 0 | 7 | 10.41 | Intron+ve, ASD > 4, Normals < 2, no Sanger filter applied |
| 9 | 207 | 111613989 | 111616410 | 2,421 | loss | 1420 | PALM2-AKAP2, PALM2 | N | 0 | 5 | 7.42 | Intron+ve, ASD > 4, Normals < 2, no Sanger filter applied |
| 9 | 207 | 111613989 | 111616410 | 2,421 | loss | 1475 | PALM2-AKAP2, PALM2 | N | 0 | 5 | 7.42 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 9 | 207 | 111613989 | 111616410 | 2,421 | loss | 1516 | PALM2-AKAP2, PALM2 | N | 0 | 5 | 7.42 | Intron+ve, ASD > 4, Normals < 2, no Sanger filter applied |
| 9 | 207 | 111613989 | 111616410 | 2,421 | gain | 1680 | PALM2-AKAP2, PALM2 | N | 0 | 5 | 7.42 | Intron+ve, ASD > 4, Normals < 2, no Sanger filter applied |
| 9 | 207 | 111613989 | 111616410 | 2,421 | loss | 1893 | PALM2-AKAP2, PALM2 | N | 0 | 5 | 7.42 | Intron+ve, ASD > 4, Normals < 2, no Sanger filter applied |
| 9 | 208 | 122900703 | 122906633 | 5,930 | loss | 1698 | CEP110 | N | 0 | 7 | 10.41 | Intron+ve, ASD > 4, Normals < 2, no Sanger filter applied |
| 9 | 208 | 122900703 | 122906633 | 5,930 | loss | 1734 | CEP110 | N | 0 | 7 | 10.41 | Intron+ve, ASD > 4, Normals < 2, no Sanger filter applied |
| 9 | 208 | 122900703 | 122906633 | 5,930 | loss | 1755 | CEP110 | N | 0 | 7 | 10.41 | Intron+ve, ASD > 4, Normals < 2, no Sanger filter applied |
| 9 | 208 | 122900703 | 122906633 | 5,930 | loss | 1762 | CEP110 | N | 0 | 7 | 10.41 | Intron+ve, ASD > 4, Normals < 2, no Sanger filter applied |
| 9 | 208 | 122900703 | 122906633 | 5,930 | loss | 1952 | CEP110 | N | 0 | 7 | 10.41 | Intron+ve, ASD > 4, Normals < 2, no Sanger filter applied |
| 9 | 208 | 122900703 | 122906633 | 5,930 | loss | 1959 | CEP110 | N | 0 | 7 | 10.41 | Intron+ve, ASD > 4, Normals < 2, no Sanger filter applied |
| 9 | 208 | 122900703 | 122906633 | 5,930 | loss | 1964 | CEP110 | N | 0 | 7 | 10.41 | Intron+ve, ASD > 4, Normals < 2, no Sanger filter applied |
| 9 | 209 | 134091469 | 134110043 | 18,574 | loss | 1230 | NTNG2 | Y | 1 | 2 | 2.95 | Exon+ve, 5 > ASD > 1, Normals < 2, Sanger−ve |
| 9 | 209 | 134091469 | 134110043 | 18,574 | loss | 1639 | NTNG2 | Y | 1 | 2 | 2.95 | Exon+ve, 5 > ASD > 1, Normals < 2, Sanger−ve |
| 9 | 210 | 134544331 | 134545846 | 1,515 | loss | 1345 | GTF3C4 | Y | 1 | 2 | 2.95 | Exon+ve, 5 > ASD > 1, Normals < 2, Sanger−ve |
| 9 | 210 | 134544331 | 134545846 | 1,515 | loss | 2036 | GTF3C4 | Y | 1 | 2 | 2.95 | Exon+ve, 5 > ASD > 1, Normals < 2, Sanger−ve |
| 10 | 211 | 885098 | 897387 | 12,289 | loss | 1293 | LARP4B | N | 0 | 6 | 8.91 | Intron+ve, ASD > 4, Normals < 2, no Sanger filter applied |
| 10 | 211 | 885098 | 897387 | 12,289 | loss | 1813 | LARP4B | N | 0 | 6 | 8.91 | Intron+ve, ASD > 4, Normals < 2, no Sanger filter applied |
| 10 | 211 | 885098 | 897387 | 12,289 | loss | 1845 | LARP4B | N | 0 | 6 | 8.91 | Intron+ve, ASD > 4, Normals < 2, no Sanger filter applied |
| 10 | 211 | 885098 | 897387 | 12,289 | loss | 1855 | LARP4B | N | 0 | 6 | 8.91 | Intron+ve, ASD > 4, Normals < 2, no Sanger filter applied |
| 10 | 211 | 885098 | 897387 | 12,289 | loss | 1953 | LARP4B | N | 0 | 6 | 8.91 | Intron+ve, ASD > 4, Normals < 2, no Sanger filter applied |
| 10 | 211 | 885098 | 897387 | 12,289 | loss | 2031 | LARP4B | N | 0 | 6 | 8.91 | Intron+ve, ASD > 4, Normals < 2, no Sanger filter applied |
| 10 | 212 | 15026547 | 15041058 | 14,511 | gain | 1243 | DCLRE1C | Y | 1 | 8 | 11.92 | Exon+ve, ASD > 4, Normals < 2, no Sanger filter applied |
| 10 | 212 | 15026547 | 15041058 | 14,511 | gain | 1298 | DCLRE1C | Y | 1 | 8 | 11.92 | Exon+ve, ASD > 4, Normals < 2, no Sanger filter applied |
| 10 | 212 | 15026547 | 15041058 | 14,511 | gain | 1760 | DCLRE1C | Y | 1 | 8 | 11.92 | Exon+ve, ASD > 4, Normals < 2, no Sanger filter applied |
| 10 | 212 | 15026547 | 15041058 | 14,511 | gain | 1877 | DCLRE1C | Y | 1 | 8 | 11.92 | Exon+ve, ASD > 4, Normals < 2, no Sanger filter applied |
| 10 | 212 | 15026547 | 15041058 | 14,511 | gain | 1894 | DCLRE1C | Y | 1 | 8 | 11.92 | Exon+ve, ASD > 4, Normals < 2, no Sanger filter applied |
| 10 | 212 | 15026547 | 15041058 | 14,511 | gain | 1910 | DCLRE1C | Y | 1 | 8 | 11.92 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 10 | 212 | 15026547 | 15041058 | 14,511 | gain | 1936 | DCLRE1C | Y | 1 | 8 | 11.92 | Exon+ve, ASD > 4, Normals < 2, no Sanger filter applied |
| 10 | 212 | 15026547 | 15041058 | 14,511 | loss | 1948 | DCLRE1C | Y | 1 | 8 | 11.92 | Exon+ve, ASD > 4, Normals < 2, no Sanger filter applied |
| 10 | 213 | 15041059 | 15047327 | 6,268 | gain | 1243 | MEIG1 | Y | 1 | 9 | 13.43 | Exon+ve, ASD > 4, Normals < 2, no Sanger filter applied |
| 10 | 213 | 15041059 | 15047327 | 6,268 | gain | 1298 | MEIG1 | Y | 1 | 9 | 13.43 | Exon+ve, ASD > 4, Normals < 2, no Sanger filter applied |
| 10 | 213 | 15041059 | 15047327 | 6,268 | gain | 1570 | MEIG1 | Y | 1 | 9 | 13.43 | Exon+ve, ASD > 4, Normals < 2, no Sanger filter applied |
| 10 | 213 | 15041059 | 15047327 | 6,268 | gain | 1760 | MEIG1 | Y | 1 | 9 | 13.43 | Exon+ve, ASD > 4, Normals < 2, no Sanger filter applied |
| 10 | 213 | 15041059 | 15047327 | 6,268 | gain | 1877 | MEIG1 | Y | 1 | 9 | 13.43 | Exon+ve, ASD > 4, Normals < 2, no Sanger filter applied |
| 10 | 213 | 15041059 | 15047327 | 6,268 | gain | 1894 | MEIG1 | Y | 1 | 9 | 13.43 | Exon+ve, ASD > 4, Normals < 2, no Sanger filter applied |
| 10 | 213 | 15041059 | 15047327 | 6,268 | gain | 1910 | MEIG1 | Y | 1 | 9 | 13.43 | Exon+ve, ASD > 4, Normals < 2, no Sanger filter applied |
| 10 | 214 | 15041059 | 15047327 | 6,268 | gain | 1936 | MEIG1 | Y | 1 | 9 | 13.43 | Exon+ve, ASD > 4, Normals < 2, no Sanger filter applied |
| 10 | 214 | 15041059 | 15047327 | 6,268 | loss | 1948 | MEIG1 | Y | 1 | 9 | 13.43 | Exon+ve, ASD > 4, Normals < 2, no Sanger filter applied |
| 10 | 215 | 15047328 | 15055229 | 7,901 | gain | 1243 | MEIG1 | Y | 1 | 8 | 11.92 | Exon+ve, ASD > 4, Normals < 2, no Sanger filter applied |
| 10 | 215 | 15047328 | 15055229 | 7,901 | gain | 1298 | MEIG1 | Y | 1 | 8 | 11.92 | Exon+ve, ASD > 4, Normals < 2, no Sanger filter applied |
| 10 | 215 | 15047328 | 15055229 | 7,901 | gain | 1760 | MEIG1 | Y | 1 | 8 | 11.92 | Exon+ve, ASD > 4, Normals < 2, no Sanger filter applied |
| 10 | 215 | 15047328 | 15055229 | 7,901 | gain | 1877 | MEIG1 | Y | 1 | 8 | 11.92 | Exon+ve, ASD > 4, Normals < 2, no Sanger filter applied |
| 10 | 215 | 15047328 | 15055229 | 7,901 | gain | 1894 | MEIG1 | Y | 1 | 8 | 11.92 | Exon+ve, ASD > 4, Normals < 2, no Sanger filter applied |
| 10 | 215 | 15047328 | 15055229 | 7,901 | gain | 1910 | MEIG1 | Y | 1 | 8 | 11.92 | Exon+ve, ASD > 4, Normals < 2, no Sanger filter applied |
| 10 | 215 | 15047328 | 15055229 | 7,901 | gain | 1936 | MEIG1 | Y | 1 | 8 | 11.92 | Exon+ve, ASD > 4, Normals < 2, no Sanger filter applied |
| 10 | 215 | 15047328 | 15055229 | 7,901 | loss | 1948 | MEIG1 | Y | 1 | 8 | 11.92 | Exon+ve, ASD > 4, Normals < 2, no Sanger filter applied |
| 10 | 216 | 24584817 | 24586451 | 1,634 | gain | 1504 | KIAA1217, PRINS | Y | 1 | 2 | 2.95 | Exon+ve, 5 > ASD > 1, Normals < 2, Sanger-ve |
| 10 | 216 | 24584817 | 24586451 | 1,634 | gain | 1726 | KIAA1217, PRINS | Y | 1 | 2 | 2.95 | Exon+ve, 5 > ASD > 1, Normals < 2, Sanger-ve |
| 10 | 217 | 42887273 | 42955951 | 68,678 | gain | 1746 | CSGALNACT2, RET | Y | 1 | 2 | 2.95 | Exon+ve, 5 > ASD > 1, Normals < 2, Sanger-ve |
| 10 | 217 | 42887273 | 42955951 | 68,678 | gain | 1968 | CSGALNACT2, RET | Y | 1 | 2 | 2.95 | Exon+ve, 5 > ASD > 1, Normals < 2, Sanger-ve |
| 10 | 218 | 43009998 | 43031954 | 21,956 | gain | 1746 | RASGEF1A | Y | 1 | 2 | 2.95 | Exon+ve, 5 > ASD > 1, Normals < 2, Sanger-ve |
| 10 | 218 | 43009998 | 43031954 | 21,956 | gain | 1968 | RASGEF1A | Y | 1 | 2 | 2.95 | Exon+ve, 5 > ASD > 1, Normals < 2, Sanger-ve |
| 10 | 219 | 45487335 | 45489822 | 2,487 | gain | 1293 | ANUBL1 | Y | 1 | 4 | 5.92 | Exon+ve, 5 > ASD > 1, Normals < 2, Sanger-ve |
| 10 | 219 | 45487335 | 45489822 | 2,487 | gain | 1408 | ANUBL1 | Y | 1 | 4 | 5.92 | Exon+ve, 5 > ASD > 1, Normals < 2, Sanger-ve |
| 10 | 219 | 45487335 | 45489822 | 2,487 | gain | 1653 | ANUBL1 | Y | 1 | 4 | 5.92 | Exon+ve, 5 > ASD > 1, Normals < 2, Sanger-ve |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 10 | 219 | 45487335 | 45489822 | 2,487 | gain | 1832 | ANUBL1 | Y | 1 | 4 | 5.92 | Exon+ve, 5 > ASD > 1, Normals < 2, Sanger−ve |
| 10 | 220 | 56140997 | 56142414 | 1,417 | gain | 1429 | PCDH15 | N | 0 | 6 | 8.91 | Intron+ve, ASD > 4, Normals < 2, no Sanger filter applied |
| 10 | 220 | 56140997 | 56142414 | 1,417 | gain | 1605 | PCDH15 | N | 0 | 6 | 8.91 | Intron+ve, ASD > 4, Normals < 2, no Sanger filter applied |
| 10 | 220 | 56140997 | 56142414 | 1,417 | loss | 1631 | PCDH15 | N | 0 | 6 | 8.91 | Intron+ve, ASD > 4, Normals < 2, no Sanger filter applied |
| 10 | 220 | 56140997 | 56142414 | 1,417 | loss | 1684 | PCDH15 | N | 0 | 6 | 8.91 | Intron+ve, ASD > 4, Normals < 2, no Sanger filter applied |
| 10 | 220 | 56140997 | 56142414 | 1,417 | gain | 1897 | PCDH15 | N | 0 | 6 | 8.91 | Intron+ve, ASD > 4, Normals < 2, no Sanger filter applied |
| 10 | 220 | 56140997 | 56142414 | 1,417 | gain | 1935 | PCDH15 | N | 0 | 6 | 8.91 | Intron+ve, ASD > 4, Normals < 2, no Sanger filter applied |
| 10 | 221 | 56142415 | 56154328 | 11,913 | gain | 1429 | PCDH15 | N | 0 | 5 | 7.42 | Intron+ve, ASD > 4, Normals < 2, no Sanger filter applied |
| 10 | 221 | 56142415 | 56154328 | 11,913 | gain | 1605 | PCDH15 | N | 0 | 5 | 7.42 | Intron+ve, ASD > 4, Normals < 2, no Sanger filter applied |
| 10 | 221 | 56142415 | 56154328 | 11,913 | loss | 1631 | PCDH15 | N | 0 | 5 | 7.42 | Intron+ve, ASD > 4, Normals < 2, no Sanger filter applied |
| 10 | 221 | 56142415 | 56154328 | 11,913 | loss | 1684 | PCDH15 | N | 0 | 5 | 7.42 | Intron+ve, ASD > 4, Normals < 2, no Sanger filter applied |
| 10 | 221 | 56142415 | 56154328 | 11,913 | gain | 1897 | PCDH15 | N | 0 | 5 | 7.42 | Intron+ve, ASD > 4, Normals < 2, no Sanger filter applied |
| 10 | 222 | 57028397 | 57031555 | 3,158 | gain | 1429 | MTRNR2L5 | Y | 2 | 3 | 0.98 | MTRNR2L_family |
| 10 | 222 | 57028397 | 57031555 | 3,158 | loss | 1583 | MTRNR2L5 | Y | 2 | 3 | 0.98 | MTRNR2L_family |
| 10 | 223 | 67803521 | 67817917 | 14,396 | loss | 1441 | CTNNA3 | Y | 1 | 2 | 2.95 | Exon+ve, 5 > ASD > 1, Normals < 2, Sanger−ve |
| 10 | 223 | 67803521 | 67817917 | 14,396 | loss | 1446 | CTNNA3 | Y | 1 | 2 | 2.95 | Exon+ve, 5 > ASD > 1, Normals < 2, Sanger−ve |
| 10 | 224 | 77916218 | 77917869 | 1,651 | gain | 1272 | C10orf11 | N | 0 | 16 | 24.12 | Intron+ve, ASD > 4, Normals < 2, no Sanger filter applied |
| 10 | 224 | 77916218 | 77917869 | 1,651 | loss | 1305 | C10orf11 | N | 0 | 16 | 24.12 | Intron+ve, ASD > 4, Normals < 2, no Sanger filter applied |
| 10 | 224 | 77916218 | 77917869 | 1,651 | loss | 1321 | C10orf11 | N | 0 | 16 | 24.12 | Intron+ve, ASD > 4, Normals < 2, no Sanger filter applied |
| 10 | 224 | 77916218 | 77917869 | 1,651 | loss | 1347 | C10orf11 | N | 0 | 16 | 24.12 | Intron+ve, ASD > 4, Normals < 2, no Sanger filter applied |
| 10 | 224 | 77916218 | 77917869 | 1,651 | gain | 1389 | C10orf11 | N | 0 | 16 | 24.12 | Intron+ve, ASD > 4, Normals < 2, no Sanger filter applied |
| 10 | 224 | 77916218 | 77917869 | 1,651 | loss | 1426 | C10orf11 | N | 0 | 16 | 24.12 | Intron+ve, ASD > 4, Normals < 2, no Sanger filter applied |
| 10 | 224 | 77916218 | 77917869 | 1,651 | loss | 1455 | C10orf11 | N | 0 | 16 | 24.12 | Intron+ve, ASD > 4, Normals < 2, no Sanger filter applied |
| 10 | 224 | 77916218 | 77917869 | 1,651 | loss | 1504 | C10orf11 | N | 0 | 16 | 24.12 | Intron+ve, ASD > 4, Normals < 2, no Sanger filter applied |
| 10 | 224 | 77916218 | 77917869 | 1,651 | loss | 1517 | C10orf11 | N | 0 | 16 | 24.12 | Intron+ve, ASD > 4, Normals < 2, no Sanger filter applied |
| 10 | 224 | 77916218 | 77917869 | 1,651 | loss | 1567 | C10orf11 | N | 0 | 16 | 24.12 | Intron+ve, ASD > 4, Normals < 2, no Sanger filter applied |
| 10 | 224 | 77916218 | 77917869 | 1,651 | gain | 1574 | C10orf11 | N | 0 | 16 | 24.12 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 10 | 224 | 77916218 | 77917869 | 1,651 | loss | 1582 | C10orf11 | N | 0 | 16 | 24.12 | Intron+ve, ASD > 4, Normals < 2, no Sanger filter applied |
| 10 | 224 | 77916218 | 77917869 | 1,651 | gain | 1592 | C10orf11 | N | 0 | 16 | 24.12 | Intron+ve, ASD > 4, Normals < 2, no Sanger filter applied |
| 10 | 224 | 77916218 | 77917869 | 1,651 | loss | 1598 | C10orf11 | N | 0 | 16 | 24.12 | Intron+ve, ASD > 4, Normals < 2, no Sanger filter applied |
| 10 | 224 | 77916218 | 77917869 | 1,651 | gain | 1743 | C10orf11 | N | 0 | 16 | 24.12 | Intron+ve, ASD > 4, Normals < 2, no Sanger filter applied |
| 10 | 224 | 77916218 | 77917869 | 1,651 | gain | 1748 | C10orf11 | N | 0 | 16 | 24.12 | Intron+ve, ASD > 4, Normals < 2, no Sanger filter applied |
| 10 | 225 | 77917870 | 77917892 | 22 | gain | 1272 | C10orf11 | N | 0 | 21 | 31.9 | Intron+ve, ASD > 4, Normals < 2, no Sanger filter applied |
| 10 | 225 | 77917870 | 77917892 | 22 | loss | 1305 | C10orf11 | N | 0 | 21 | 31.9 | Intron+ve, ASD > 4, Normals < 2, no Sanger filter applied |
| 10 | 225 | 77917870 | 77917892 | 22 | loss | 1321 | C10orf11 | N | 0 | 21 | 31.9 | Intron+ve, ASD > 4, Normals < 2, no Sanger filter applied |
| 10 | 225 | 77917870 | 77917892 | 22 | loss | 1347 | C10orf11 | N | 0 | 21 | 31.9 | Intron+ve, ASD > 4, Normals < 2, no Sanger filter applied |
| 10 | 225 | 77917870 | 77917892 | 22 | gain | 1389 | C10orf11 | N | 0 | 21 | 31.9 | Intron+ve, ASD > 4, Normals < 2, no Sanger filter applied |
| 10 | 225 | 77917870 | 77917892 | 22 | loss | 1426 | C10orf11 | N | 0 | 21 | 31.9 | Intron+ve, ASD > 4, Normals < 2, no Sanger filter applied |
| 10 | 225 | 77917870 | 77917892 | 22 | loss | 1455 | C10orf11 | N | 0 | 21 | 31.9 | Intron+ve, ASD > 4, Normals < 2, no Sanger filter applied |
| 10 | 225 | 77917870 | 77917892 | 22 | loss | 1504 | C10orf11 | N | 0 | 21 | 31.9 | Intron+ve, ASD > 4, Normals < 2, no Sanger filter applied |
| 10 | 225 | 77917870 | 77917892 | 22 | loss | 1517 | C10orf11 | N | 0 | 21 | 31.9 | Intron+ve, ASD > 4, Normals < 2, no Sanger filter applied |
| 10 | 225 | 77917870 | 77917892 | 22 | gain | 1540 | C10orf11 | N | 0 | 21 | 31.9 | Intron+ve, ASD > 4, Normals < 2, no Sanger filter applied |
| 10 | 225 | 77917870 | 77917892 | 22 | loss | 1567 | C10orf11 | N | 0 | 21 | 31.9 | Intron+ve, ASD > 4, Normals < 2, no Sanger filter applied |
| 10 | 225 | 77917870 | 77917892 | 22 | gain | 1574 | C10orf11 | N | 0 | 21 | 31.9 | Intron+ve, ASD > 4, Normals < 2, no Sanger filter applied |
| 10 | 225 | 77917870 | 77917892 | 22 | loss | 1582 | C10orf11 | N | 0 | 21 | 31.9 | Intron+ve, ASD > 4, Normals < 2, no Sanger filter applied |
| 10 | 225 | 77917870 | 77917892 | 22 | gain | 1592 | C10orf11 | N | 0 | 21 | 31.9 | Intron+ve, ASD > 4, Normals < 2, no Sanger filter applied |
| 10 | 225 | 77917870 | 77917892 | 22 | loss | 1598 | C10orf11 | N | 0 | 21 | 31.9 | Intron+ve, ASD > 4, Normals < 2, no Sanger filter applied |
| 10 | 225 | 77917870 | 77917892 | 22 | gain | 1606 | C10orf11 | N | 0 | 21 | 31.9 | Intron+ve, ASD > 4, Normals < 2, no Sanger filter applied |
| 10 | 225 | 77917870 | 77917892 | 22 | gain | 1733 | C10orf11 | N | 0 | 21 | 31.9 | Intron+ve, ASD > 4, Normals < 2, no Sanger filter applied |
| 10 | 225 | 77917870 | 77917892 | 22 | gain | 1743 | C10orf11 | N | 0 | 21 | 31.9 | Intron+ve, ASD > 4, Normals < 2, no Sanger filter applied |
| 10 | 225 | 77917870 | 77917892 | 22 | gain | 1748 | C10orf11 | N | 0 | 21 | 31.9 | Intron+ve, ASD > 4, Normals < 2, no Sanger filter applied |
| 10 | 225 | 77917870 | 77917892 | 22 | gain | 1755 | C10orf11 | N | 0 | 21 | 31.9 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 10 | 225 | 77917870 | 77917892 | 22 | gain | 1893 | C10orf11 | N | 0 | 21 | 31.9 | Intron+ve, ASD > 4, Normals < 2, no Sanger filter applied |
| 10 | 226 | 77928739 | 77940201 | 11,462 | gain | 1267 | C10orf11 | N | 0 | 9 | 13.43 | Intron+ve, ASD > 4, Normals < 2, no Sanger filter applied |
| 10 | 226 | 77928739 | 77940201 | 11,462 | gain | 1279 | C10orf11 | N | 0 | 9 | 13.43 | Intron+ve, ASD > 4, Normals < 2, no Sanger filter applied |
| 10 | 226 | 77928739 | 77940201 | 11,462 | loss | 1426 | C10orf11 | N | 0 | 9 | 13.43 | Intron+ve, ASD > 4, Normals < 2, no Sanger filter applied |
| 10 | 226 | 77928739 | 77940201 | 11,462 | loss | 1504 | C10orf11 | N | 0 | 9 | 13.43 | Intron+ve, ASD > 4, Normals < 2, no Sanger filter applied |
| 10 | 226 | 77928739 | 77940201 | 11,462 | gain | 1667 | C10orf11 | N | 0 | 9 | 13.43 | Intron+ve, ASD > 4, Normals < 2, no Sanger filter applied |
| 10 | 226 | 77928739 | 77940201 | 11,462 | gain | 1728 | C10orf11 | N | 0 | 9 | 13.43 | Intron+ve, ASD > 4, Normals < 2, no Sanger filter applied |
| 10 | 226 | 77928739 | 77940201 | 11,462 | gain | 1748 | C10orf11 | N | 0 | 9 | 13.43 | Intron+ve, ASD > 4, Normals < 2, no Sanger filter applied |
| 10 | 226 | 77928739 | 77940201 | 11,462 | gain | 1755 | C10orf11 | N | 0 | 9 | 13.43 | Intron+ve, ASD > 4, Normals < 2, no Sanger filter applied |
| 10 | 226 | 77928739 | 77940201 | 11,462 | gain | 1766 | C10orf11 | N | 0 | 9 | 13.43 | Intron+ve, ASD > 4, Normals < 2, no Sanger filter applied |
| 10 | 227 | 77940202 | 77942809 | 2,607 | gain | 1279 | C10orf11 | N | 0 | 6 | 8.91 | Intron+ve, ASD > 4, Normals < 2, no Sanger filter applied |
| 10 | 227 | 77940202 | 77942809 | 2,607 | loss | 1426 | C10orf11 | N | 0 | 6 | 8.91 | Intron+ve, ASD > 4, Normals < 2, no Sanger filter applied |
| 10 | 227 | 77940202 | 77942809 | 2,607 | gain | 1667 | C10orf11 | N | 0 | 6 | 8.91 | Intron+ve, ASD > 4, Normals < 2, no Sanger filter applied |
| 10 | 227 | 77940202 | 77942809 | 2,607 | gain | 1728 | C10orf11 | N | 0 | 6 | 8.91 | Intron+ve, ASD > 4, Normals < 2, no Sanger filter applied |
| 10 | 227 | 77940202 | 77942809 | 2,607 | gain | 1755 | C10orf11 | N | 0 | 6 | 8.91 | Intron+ve, ASD > 4, Normals < 2, no Sanger filter applied |
| 10 | 227 | 77940202 | 77942809 | 2,607 | gain | 1766 | C10orf11 | N | 0 | 6 | 8.91 | Intron+ve, ASD > 4, Normals < 2, no Sanger filter applied |
| 10 | 228 | 108856357 | 108866592 | 10,235 | gain | 1269 | SORCS1 | N | 0 | 9 | 13.43 | Intron+ve, ASD > 4, Normals < 2, no Sanger filter applied |
| 10 | 228 | 108856357 | 108866592 | 10,235 | loss | 1299 | SORCS1 | N | 0 | 9 | 13.43 | Intron+ve, ASD > 4, Normals < 2, no Sanger filter applied |
| 10 | 228 | 108856357 | 108866592 | 10,235 | loss | 1315 | SORCS1 | N | 0 | 9 | 13.43 | Intron+ve, ASD > 4, Normals < 2, no Sanger filter applied |
| 10 | 228 | 108856357 | 108866592 | 10,235 | loss | 1465 | SORCS1 | N | 0 | 9 | 13.43 | Intron+ve, ASD > 4, Normals < 2, no Sanger filter applied |
| 10 | 228 | 108856357 | 108866592 | 10,235 | loss | 1492 | SORCS1 | N | 0 | 9 | 13.43 | Intron+ve, ASD > 4, Normals < 2, no Sanger filter applied |
| 10 | 228 | 108856357 | 108866592 | 10,235 | loss | 1495 | SORCS1 | N | 0 | 9 | 13.43 | Intron+ve, ASD > 4, Normals < 2, no Sanger filter applied |
| 10 | 228 | 108856357 | 108866592 | 10,235 | loss | 1566 | SORCS1 | N | 0 | 9 | 13.43 | Intron+ve, ASD > 4, Normals < 2, no Sanger filter applied |
| 10 | 228 | 108856357 | 108866592 | 10,235 | loss | 1720 | SORCS1 | N | 0 | 9 | 13.43 | Intron+ve, ASD > 4, Normals < 2, no Sanger filter applied |
| 10 | 228 | 108856357 | 108866592 | 10,235 | loss | 1758 | SORCS1 | N | 0 | 9 | 13.43 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 10 | 229 | 116940096 | 116949326 | 9,230 | gain | 1394 | ATRNL1 | N | 0 | 8 | 11.92 | Intron+ve, ASD > 4, Normals < 2, no Sanger filter applied |
| 10 | 229 | 116940096 | 116949326 | 9,230 | gain | 1409 | ATRNL1 | N | 0 | 8 | 11.92 | Intron+ve, ASD > 4, Normals < 2, no Sanger filter applied |
| 10 | 229 | 116940096 | 116949326 | 9,230 | gain | 1410 | ATRNL1 | N | 0 | 8 | 11.92 | Intron+ve, ASD > 4, Normals < 2, no Sanger filter applied |
| 10 | 229 | 116940096 | 116949326 | 9,230 | gain | 1416 | ATRNL1 | N | 0 | 8 | 11.92 | Intron+ve, ASD > 4, Normals < 2, no Sanger filter applied |
| 10 | 229 | 116940096 | 116949326 | 9,230 | gain | 1438 | ATRNL1 | N | 0 | 8 | 11.92 | Intron+ve, ASD > 4, Normals < 2, no Sanger filter applied |
| 10 | 229 | 116940096 | 116949326 | 9,230 | gain | 1603 | ATRNL1 | N | 0 | 8 | 11.92 | Intron+ve, ASD > 4, Normals < 2, no Sanger filter applied |
| 10 | 229 | 116940096 | 116949326 | 9,230 | gain | 1834 | ATRNL1 | N | 0 | 8 | 11.92 | Intron+ve, ASD > 4, Normals < 2, no Sanger filter applied |
| 10 | 229 | 116940096 | 116949326 | 9,230 | gain | 1924 | ATRNL1 | N | 0 | 8 | 11.92 | Intron+ve, ASD > 4, Normals < 2, no Sanger filter applied |
| 10 | 230 | 116949327 | 116953710 | 4,383 | gain | 1292 | ATRNL1 | N | 0 | 11 | 16.46 | Intron+ve, ASD > 4, Normals < 2, no Sanger filter applied |
| 10 | 230 | 116949327 | 116953710 | 4,383 | gain | 1346 | ATRNL1 | N | 0 | 11 | 16.46 | Intron+ve, ASD > 4, Normals < 2, no Sanger filter applied |
| 10 | 230 | 116949327 | 116953710 | 4,383 | gain | 1394 | ATRNL1 | N | 0 | 11 | 16.46 | Intron+ve, ASD > 4, Normals < 2, no Sanger filter applied |
| 10 | 230 | 116949327 | 116953710 | 4,383 | gain | 1409 | ATRNL1 | N | 0 | 11 | 16.46 | Intron+ve, ASD > 4, Normals < 2, no Sanger filter applied |
| 10 | 230 | 116949327 | 116953710 | 4,383 | gain | 1410 | ATRNL1 | N | 0 | 11 | 16.46 | Intron+ve, ASD > 4, Normals < 2, no Sanger filter applied |
| 10 | 230 | 116949327 | 116953710 | 4,383 | gain | 1416 | ATRNL1 | N | 0 | 11 | 16.46 | Intron+ve, ASD > 4, Normals < 2, no Sanger filter applied |
| 10 | 230 | 116949327 | 116953710 | 4,383 | gain | 1438 | ATRNL1 | N | 0 | 11 | 16.46 | Intron+ve, ASD > 4, Normals < 2, no Sanger filter applied |
| 10 | 230 | 116949327 | 116953710 | 4,383 | gain | 1603 | ATRNL1 | N | 0 | 11 | 16.46 | Intron+ve, ASD > 4, Normals < 2, no Sanger filter applied |
| 10 | 230 | 116949327 | 116953710 | 4,383 | gain | 1834 | ATRNL1 | N | 0 | 11 | 16.46 | Intron+ve, ASD > 4, Normals < 2, no Sanger filter applied |
| 10 | 230 | 116949327 | 116953710 | 4,383 | gain | 1880 | ATRNL1 | N | 0 | 11 | 16.46 | Intron+ve, ASD > 4, Normals < 2, no Sanger filter applied |
| 10 | 230 | 116949327 | 116953710 | 4,383 | gain | 1924 | ATRNL1 | N | 0 | 11 | 16.46 | Intron+ve, ASD > 4, Normals < 2, no Sanger filter applied |
| 10 | 231 | 116953712 | 116958657 | 4,945 | gain | 1292 | ATRNL1 | N | 0 | 11 | 16.46 | Intron+ve, ASD > 4, Normals < 2, no Sanger filter applied |
| 10 | 231 | 116953712 | 116958657 | 4,945 | gain | 1346 | ATRNL1 | N | 0 | 11 | 16.46 | Intron+ve, ASD > 4, Normals < 2, no Sanger filter applied |
| 10 | 231 | 116953712 | 116958657 | 4,945 | gain | 1394 | ATRNL1 | N | 0 | 11 | 16.46 | Intron+ve, ASD > 4, Normals < 2, no Sanger filter applied |
| 10 | 231 | 116953712 | 116958657 | 4,945 | gain | 1409 | ATRNL1 | N | 0 | 11 | 16.46 | Intron+ve, ASD > 4, Normals < 2, no Sanger filter applied |
| 10 | 231 | 116953712 | 116958657 | 4,945 | gain | 1410 | ATRNL1 | N | 0 | 11 | 16.46 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 10 | 231 | 116953712 | 116958657 | 4,945 | gain | 1416 | ATRNL1 | N | 0 | 11 | 16.46 | Intron+ve, ASD > 4, Normals < 2, no Sanger filter applied |
| 10 | 231 | 116953712 | 116958657 | 4,945 | gain | 1603 | ATRNL1 | N | 0 | 11 | 16.46 | Intron+ve, ASD > 4, Normals < 2, no Sanger filter applied |
| 10 | 231 | 116953712 | 116958657 | 4,945 | gain | 1761 | ATRNL1 | N | 0 | 11 | 16.46 | Intron+ve, ASD > 4, Normals < 2, no Sanger filter applied |
| 10 | 231 | 116953712 | 116958657 | 4,945 | gain | 1834 | ATRNL1 | N | 0 | 11 | 16.46 | Intron+ve, ASD > 4, Normals < 2, no Sanger filter applied |
| 10 | 231 | 116953712 | 116958657 | 4,945 | gain | 1880 | ATRNL1 | N | 0 | 11 | 16.46 | Intron+ve, ASD > 4, Normals < 2, no Sanger filter applied |
| 10 | 231 | 116953712 | 116958657 | 4,945 | gain | 1924 | ATRNL1 | N | 0 | 11 | 16.46 | Intron+ve, ASD > 4, Normals < 2, no Sanger filter applied |
| 10 | 232 | 116958658 | 116963861 | 5,203 | gain | 1292 | ATRNL1 | N | 0 | 6 | 8.91 | Intron+ve, ASD > 4, Normals < 2, no Sanger filter applied |
| 10 | 232 | 116958658 | 116963861 | 5,203 | gain | 1394 | ATRNL1 | N | 0 | 6 | 8.91 | Intron+ve, ASD > 4, Normals < 2, no Sanger filter applied |
| 10 | 232 | 116958658 | 116963861 | 5,203 | gain | 1416 | ATRNL1 | N | 0 | 6 | 8.91 | Intron+ve, ASD > 4, Normals < 2, no Sanger filter applied |
| 10 | 232 | 116958658 | 116963861 | 5,203 | gain | 1834 | ATRNL1 | N | 0 | 6 | 8.91 | Intron+ve, ASD > 4, Normals < 2, no Sanger filter applied |
| 10 | 232 | 116958658 | 116963861 | 5,203 | gain | 1880 | ATRNL1 | N | 0 | 6 | 8.91 | Intron+ve, ASD > 4, Normals < 2, no Sanger filter applied |
| 10 | 232 | 116958658 | 116963861 | 5,203 | gain | 1924 | ATRNL1 | N | 0 | 6 | 8.91 | Intron+ve, ASD > 4, Normals < 2, no Sanger filter applied |
| 11 | 233 | 4932215 | 4934594 | 2,379 | gain | 1273 | OR51A2 | Y | 1 | 14 | 21.04 | Exon+ve, ASD > 4, Normals < 2, no Sanger filter applied |
| 11 | 233 | 4932215 | 4934594 | 2,379 | gain | 1304 | OR51A2 | Y | 1 | 14 | 21.04 | Exon+ve, ASD > 4, Normals < 2, no Sanger filter applied |
| 11 | 233 | 4932215 | 4934594 | 2,379 | gain | 1346 | OR51A2 | Y | 1 | 14 | 21.04 | Exon+ve, ASD > 4, Normals < 2, no Sanger filter applied |
| 11 | 233 | 4932215 | 4934594 | 2,379 | gain | 1436 | OR51A2 | Y | 1 | 14 | 21.04 | Exon+ve, ASD > 4, Normals < 2, no Sanger filter applied |
| 11 | 233 | 4932215 | 4934594 | 2,379 | gain | 1453 | OR51A2 | Y | 1 | 14 | 21.04 | Exon+ve, ASD > 4, Normals < 2, no Sanger filter applied |
| 11 | 233 | 4932215 | 4934594 | 2,379 | gain | 1577 | OR51A2 | Y | 1 | 14 | 21.04 | Exon+ve, ASD > 4, Normals < 2, no Sanger filter applied |
| 11 | 233 | 4932215 | 4934594 | 2,379 | gain | 1594 | OR51A2 | Y | 1 | 14 | 21.04 | Exon+ve, ASD > 4, Normals < 2, no Sanger filter applied |
| 11 | 233 | 4932215 | 4934594 | 2,379 | gain | 1669 | OR51A2 | Y | 1 | 14 | 21.04 | Exon+ve, ASD > 4, Normals < 2, no Sanger filter applied |
| 11 | 233 | 4932215 | 4934594 | 2,379 | gain | 1744 | OR51A2 | Y | 1 | 14 | 21.04 | Exon+ve, ASD > 4, Normals < 2, no Sanger filter applied |
| 11 | 233 | 4932215 | 4934594 | 2,379 | gain | 1813 | OR51A2 | Y | 1 | 14 | 21.04 | Exon+ve, ASD > 4, Normals < 2, no Sanger filter applied |
| 11 | 233 | 4932215 | 4934594 | 2,379 | gain | 1858 | OR51A2 | Y | 1 | 14 | 21.04 | Exon+ve, ASD > 4, Normals < 2, no Sanger filter applied |
| 11 | 233 | 4932215 | 4934594 | 2,379 | gain | 1880 | OR51A2 | Y | 1 | 14 | 21.04 | Exon+ve, ASD > 4, Normals < 2, no Sanger filter applied |
| 11 | 233 | 4932215 | 4934594 | 2,379 | gain | 1916 | OR51A2 | Y | 1 | 14 | 21.04 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 11 | 233 | 4932215 | 4934594 | 2,379 | gain | 1960 | OR51A2 | Y | 1 | 14 | 21.04 | Exon+ve, ASD > 4, Normals < 2, no Sanger filter applied |
| 11 | 234 | 5226853 | 5228202 | 1,349 | gain | 1424 | HBG1 | Y | 1 | 5 | 7.42 | Exon+ve, ASD > 4, Normals < 2, no Sanger filter applied |
| 11 | 234 | 5226853 | 5228202 | 1,349 | gain | 1486 | HBG1 | Y | 1 | 5 | 7.42 | Exon+ve, ASD > 4, Normals < 2, no Sanger filter applied |
| 11 | 234 | 5226853 | 5228202 | 1,349 | gain | 1758 | HBG1 | Y | 1 | 5 | 7.42 | Exon+ve, ASD > 4, Normals < 2, no Sanger filter applied |
| 11 | 234 | 5226853 | 5228202 | 1,349 | gain | 1843 | HBG1 | Y | 1 | 5 | 7.42 | Exon+ve, ASD > 4, Normals < 2, no Sanger filter applied |
| 11 | 234 | 5226853 | 5228202 | 1,349 | gain | 1911 | HBG1 | Y | 1 | 5 | 7.42 | Exon+ve, ASD > 4, Normals < 2, no Sanger filter applied |
| 11 | 235 | 5765439 | 5766615 | 1,176 | gain | 1235 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1394 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1434 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1438 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1536 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1538 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1551 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1643 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1671 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1712 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1727 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1817 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1821 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1823 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1824 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1825 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1877 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1902 | OR52N1 | Y | 0 | 22 | 33.47 | Exon+ve, ASD > 4, Normals < 2, no Sanger filter applied |
| 11 | 235 | 5765439 | 5766615 | 1,176 | gain | 1903 | OR52N1 | Y | 0 | 22 | 33.47 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 11 | 235 | 5765439 | 5766615 | 1,176 | gain | 1991 | OR52N1 | Y | 0 | 22 | 33.47 | Exon+ve, ASD > 4, Normals < 2, no Sanger filter applied |
| 11 | 235 | 5765439 | 5766615 | 1,176 | gain | 2033 | OR52N1 | Y | 0 | 22 | 33.47 | Exon+ve, ASD > 4, Normals < 2, no Sanger filter applied |
| 11 | 235 | 5765439 | 5766615 | 1,176 | gain | 2044 | OR52N1 | Y | 0 | 22 | 33.47 | Exon+ve, ASD > 4, Normals < 2, no Sanger filter applied |
| 11 | 236 | 5832681 | 5839924 | 7,243 | loss | 1574 | OR52E8 | Y | 0 | 7 | 10.41 | Exon+ve, ASD > 4, Normals < 2, no Sanger filter applied |
| 11 | 236 | 5832681 | 5839924 | 7,243 | loss | 1723 | OR52E8 | Y | 0 | 7 | 10.41 | Exon+ve, ASD > 4, Normals < 2, no Sanger filter applied |
| 11 | 236 | 5832681 | 5839924 | 7,243 | loss | 1769 | OR52E8 | Y | 0 | 7 | 10.41 | Exon+ve, ASD > 4, Normals < 2, no Sanger filter applied |
| 11 | 236 | 5832681 | 5839924 | 7,243 | loss | 1856 | OR52E8 | Y | 0 | 7 | 10.41 | Exon+ve, ASD > 4, Normals < 2, no Sanger filter applied |
| 11 | 236 | 5832681 | 5839924 | 7,243 | loss | 1858 | OR52E8 | Y | 0 | 7 | 10.41 | Exon+ve, ASD > 4, Normals < 2, no Sanger filter applied |
| 11 | 236 | 5832681 | 5839924 | 7,243 | loss | 1877 | OR52E8 | Y | 0 | 7 | 10.41 | Exon+ve, ASD > 4, Normals < 2, no Sanger filter applied |
| 11 | 236 | 5832681 | 5839924 | 7,243 | loss | 2034 | OR52E8 | Y | 0 | 7 | 10.41 | Exon+ve, ASD > 4, Normals < 2, no Sanger filter applied |
| 11 | 237 | 10210600 | 10668699 | 458,099 | loss | 1959 | MRVI1, LYVE1, AMPD3, MTRNR2L8, LOC100129827, SPF2, RNF141, ADM | Y | 0 | 1 | 1.47 | MTRNR2L_family |
| 11 | 238 | 34919050 | 34919798 | 748 | loss | 1285 | PDHX | N | 0 | 5 | 7.42 | Intron+ve, ASD > 4, Normals < 2, no Sanger filter applied |
| 11 | 238 | 34919050 | 34919798 | 748 | loss | 1572 | PDHX | N | 0 | 5 | 7.42 | Intron+ve, ASD > 4, Normals < 2, no Sanger filter applied |
| 11 | 238 | 34919050 | 34919798 | 748 | loss | 1590 | PDHX | N | 0 | 5 | 7.42 | Intron+ve, ASD > 4, Normals < 2, no Sanger filter applied |
| 11 | 238 | 34919050 | 34919798 | 748 | loss | 1688 | PDHX | N | 0 | 5 | 7.42 | Intron+ve, ASD > 4, Normals < 2, no Sanger filter applied |
| 11 | 238 | 34919050 | 34919798 | 748 | loss | 1737 | PDHX | N | 0 | 5 | 7.42 | Intron+ve, ASD > 4, Normals < 2, no Sanger filter applied |
| 11 | 239 | 51286364 | 51371826 | 85,462 | gain | 1708 | OR4C46 | Y | 1 | 2 | 2.95 | Exon+ve, 5 > ASD > 1, Normals < 2, Sanger-ve |
| 11 | 239 | 51286364 | 51371826 | 85,462 | gain | 1943 | OR4C46 | Y | 1 | 2 | 2.95 | Exon+ve, 5 > ASD > 1, Normals < 2, Sanger-ve |
| 11 | 240 | 55114405 | 55118213 | 3,808 | gain | 1222 | | N | 0 | 32 | 49.43 | high OR intergenic (OR > 30) |
| 11 | 240 | 55114405 | 55118213 | 3,808 | gain | 1230 | | N | 0 | 32 | 49.43 | high OR intergenic (OR > 30) |
| 11 | 240 | 55114405 | 55118213 | 3,808 | gain | 1270 | | N | 0 | 32 | 49.43 | high OR intergenic (OR > 30) |
| 11 | 240 | 55114405 | 55118213 | 3,808 | gain | 1271 | | N | 0 | 32 | 49.43 | high OR intergenic (OR > 30) |
| 11 | 240 | 55114405 | 55118213 | 3,808 | gain | 1285 | | N | 0 | 32 | 49.43 | high OR intergenic (OR > 30) |
| 11 | 240 | 55114405 | 55118213 | 3,808 | gain | 1296 | | N | 0 | 32 | 49.43 | high OR intergenic (OR > 30) |
| 11 | 240 | 55114405 | 55118213 | 3,808 | gain | 1542 | | N | 0 | 32 | 49.43 | high OR intergenic (OR > 30) |
| 11 | 240 | 55114405 | 55118213 | 3,808 | gain | 1545 | | N | 0 | 32 | 49.43 | high OR intergenic (OR > 30) |
| 11 | 240 | 55114405 | 55118213 | 3,808 | gain | 1590 | | N | 0 | 32 | 49.43 | high OR intergenic (OR > 30) |
| 11 | 240 | 55114405 | 55118213 | 3,808 | gain | 1607 | | N | 0 | 32 | 49.43 | high OR intergenic (OR > 30) |
| 11 | 240 | 55114405 | 55118213 | 3,808 | gain | 1608 | | N | 0 | 32 | 49.43 | high OR intergenic (OR > 30) |
| 11 | 240 | 55114405 | 55118213 | 3,808 | gain | 1711 | | N | 0 | 32 | 49.43 | high OR intergenic (OR > 30) |
| 11 | 240 | 55114405 | 55118213 | 3,808 | gain | 1721 | | N | 0 | 32 | 49.43 | high OR intergenic (OR > 30) |
| 11 | 240 | 55114405 | 55118213 | 3,808 | gain | 1750 | | N | 0 | 32 | 49.43 | high OR intergenic (OR > 30) |
| 11 | 240 | 55114405 | 55118213 | 3,808 | gain | 1755 | | N | 0 | 32 | 49.43 | high OR intergenic (OR > 30) |
| 11 | 240 | 55114405 | 55118213 | 3,808 | gain | 1763 | | N | 0 | 32 | 49.43 | high OR intergenic (OR > 30) |
| 11 | 240 | 55114405 | 55118213 | 3,808 | gain | 1783 | | N | 0 | 32 | 49.43 | high OR intergenic (OR > 30) |
| 11 | 240 | 55114405 | 55118213 | 3,808 | gain | 1787 | | N | 0 | 32 | 49.43 | high OR intergenic (OR > 30) |
| 11 | 240 | 55114405 | 55118213 | 3,808 | gain | 1793 | | N | 0 | 32 | 49.43 | high OR intergenic (OR > 30) |
| 11 | 240 | 55114405 | 55118213 | 3,808 | gain | 1807 | | N | 0 | 32 | 49.43 | high OR intergenic (OR > 30) |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 11 | 240 | 55114405 | 55118213 | 3,808 | gain | 1808 | | N | 0 | 32 | 49.43 | high OR intergenic (OR > 30) |
| 11 | 240 | 55114405 | 55118213 | 3,808 | gain | 1830 | | N | 0 | 32 | 49.43 | high OR intergenic (OR > 30) |
| 11 | 240 | 55114405 | 55118213 | 3,808 | gain | 1862 | | N | 0 | 32 | 49.43 | high OR intergenic (OR > 30) |
| 11 | 240 | 55114405 | 55118213 | 3,808 | gain | 1870 | | N | 0 | 32 | 49.43 | high OR intergenic (OR > 30) |
| 11 | 240 | 55114405 | 55118213 | 3,808 | gain | 1900 | | N | 0 | 32 | 49.43 | high OR intergenic (OR > 30) |
| 11 | 240 | 55114405 | 55118213 | 3,808 | gain | 1928 | | N | 0 | 32 | 49.43 | high OR intergenic (OR > 30) |
| 11 | 240 | 55114405 | 55118213 | 3,808 | gain | 1937 | | N | 0 | 32 | 49.43 | high OR intergenic (OR > 30) |
| 11 | 240 | 55114405 | 55118213 | 3,808 | gain | 1998 | | N | 0 | 32 | 49.43 | high OR intergenic (OR > 30) |
| 11 | 240 | 55114405 | 55118213 | 3,808 | gain | 2026 | | N | 0 | 32 | 49.43 | high OR intergenic (OR > 30) |
| 11 | 240 | 55114405 | 55118213 | 3,808 | gain | 2030 | | N | 0 | 32 | 49.43 | high OR intergenic (OR > 30) |
| 11 | 240 | 55114405 | 55118213 | 3,808 | gain | 2041 | | N | 0 | 32 | 49.43 | high OR intergenic (OR > 30) |
| 11 | 240 | 55114405 | 55118213 | 3,808 | gain | 2044 | | N | 0 | 32 | 49.43 | high OR intergenic (OR > 30) |
| 11 | 241 | 55510238 | 55516120 | 5,882 | loss | 1245 | OR7E5P | Y | 1 | 2 | 2.95 | Exon+ve, 5 > ASD > 1, Normals < 2, Sanger-ve |
| 11 | 241 | 55510238 | 55516120 | 5,882 | loss | 1868 | OR7E5P | Y | 1 | 2 | 2.95 | Exon+ve, 5 > ASD > 1, Normals < 2, Sanger-ve |
| 11 | 242 | 88560991 | 88562255 | 1,264 | loss | 1539 | TYR | N | 0 | 6 | 8.91 | Intron+ve, ASD > 4, Normals < 2, no Sanger filter applied |
| 11 | 242 | 88560991 | 88562255 | 1,264 | loss | 1691 | TYR | N | 0 | 6 | 8.91 | Intron+ve, ASD > 4, Normals < 2, no Sanger filter applied |
| 11 | 242 | 88560991 | 88562255 | 1,264 | loss | 1720 | TYR | N | 0 | 6 | 8.91 | Intron+ve, ASD > 4, Normals < 2, no Sanger filter applied |
| 11 | 242 | 88560991 | 88562255 | 1,264 | loss | 1746 | TYR | N | 0 | 6 | 8.91 | Intron+ve, ASD > 4, Normals < 2, no Sanger filter applied |
| 11 | 242 | 88560991 | 88562255 | 1,264 | loss | 1760 | TYR | N | 0 | 6 | 8.91 | Intron+ve, ASD > 4, Normals < 2, no Sanger filter applied |
| 11 | 242 | 88560991 | 88562255 | 1,264 | gain | 1993 | TYR | N | 0 | 6 | 8.91 | Intron+ve, ASD > 4, Normals < 2, no Sanger filter applied |
| 11 | 243 | 101496791 | 101499019 | 2,228 | loss | 1247 | YAP1 | N | 1 | 3 | 8.91 | Genic (distinct CNV-subregions); OR > 6 |
| 11 | 243 | 101496791 | 101499019 | 2,228 | loss | 1274 | YAP1 | N | 1 | 3 | 8.91 | Genic (distinct CNV-subregions); OR > 6 |
| 11 | 243 | 101496791 | 101499019 | 2,228 | loss | 1546 | YAP1 | N | 1 | 3 | 8.91 | Genic (distinct CNV-subregions); OR > 6 |
| 11 | 244 | 101544468 | 101550679 | 6,211 | gain | 1224 | YAP1 | N | 0 | 1 | 8.91 | Genic (distinct CNV-subregions); OR > 6 |
| 11 | 245 | 101550679 | 101554376 | 3,697 | loss | 1233 | YAP1 | N | 0 | 2 | 8.91 | Genic (distinct CNV-subregions); OR > 6 |
| 11 | 245 | 101550679 | 101554376 | 3,697 | loss | 2037 | YAP1 | N | 0 | 2 | 8.91 | Genic (distinct CNV-subregions); OR > 6 |
| 11 | 246 | 107176390 | 107177546 | 1,156 | gain | 1222 | SLC35F2 | N | 0 | 6 | 8.91 | Intron+ve, ASD > 4, Normals < 2, no Sanger filter applied |
| 11 | 246 | 107176390 | 107177546 | 1,156 | gain | 1349 | SLC35F2 | N | 0 | 6 | 8.91 | Intron+ve, ASD > 4, Normals < 2, no Sanger filter applied |
| 11 | 246 | 107176390 | 107177546 | 1,156 | gain | 1794 | SLC35F2 | N | 0 | 6 | 8.91 | Intron+ve, ASD > 4, Normals < 2, no Sanger filter applied |
| 11 | 246 | 107176390 | 107177546 | 1,156 | gain | 1818 | SLC35F2 | N | 0 | 6 | 8.91 | Intron+ve, ASD > 4, Normals < 2, no Sanger filter applied |
| 11 | 246 | 107176390 | 107177546 | 1,156 | gain | 1860 | SLC35F2 | N | 0 | 6 | 8.91 | Intron+ve, ASD > 4, Normals < 2, no Sanger filter applied |
| 11 | 246 | 107176390 | 107177546 | 1,156 | gain | 1867 | SLC35F2 | N | 0 | 6 | 8.91 | Intron+ve, ASD > 4, Normals < 2, no Sanger filter applied |
| 11 | 247 | 120856405 | 120859352 | 2,947 | gain | 1324 | SORL1 | N | 0 | 5 | 7.42 | Intron+ve, ASD > 4, Normals < 2, no Sanger filter applied |
| 11 | 247 | 120856405 | 120859352 | 2,947 | gain | 1411 | SORL1 | N | 0 | 5 | 7.42 | Intron+ve, ASD > 4, Normals < 2, no Sanger filter applied |
| 11 | 247 | 120856405 | 120859352 | 2,947 | gain | 1416 | SORL1 | N | 0 | 5 | 7.42 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 11 | 247 | 120856405 | 120859352 | 2,947 | gain | 1825 | SORL1 | N | 0 | 5 | 7.42 | Intron+ve, ASD > 4, Normals < 2, no Sanger filter applied |
| 11 | 247 | 120856405 | 120859352 | 2,947 | gain | 1834 | SORL1 | N | 0 | 5 | 7.42 | Intron+ve, ASD > 4, Normals < 2, no Sanger filter applied |
| 11 | 248 | 123756697 | 123770639 | 13,942 | gain | 1463 | OR8B2 | Y | 1 | 2 | 2.95 | Exon+ve, 5 > ASD > 1, Normals < 2, Sanger-ve |
| 11 | 248 | 123756697 | 123770639 | 13,942 | gain | 1467 | OR8B2 | Y | 1 | 2 | 2.95 | Exon+ve, 5 > ASD > 1, Normals < 2, Sanger-ve |
| 11 | 249 | 131427991 | 131429531 | 1,540 | gain | 1604 | NTM | N | 0 | 6 | 8.91 | Intron+ve, ASD > 4, Normals < 2, no Sanger filter applied |
| 11 | 249 | 131427991 | 131429531 | 1,540 | gain | 1644 | NTM | N | 0 | 6 | 8.91 | Intron+ve, ASD > 4, Normals < 2, no Sanger filter applied |
| 11 | 249 | 131427991 | 131429531 | 1,540 | gain | 1660 | NTM | N | 0 | 6 | 8.91 | Intron+ve, ASD > 4, Normals < 2, no Sanger filter applied |
| 11 | 249 | 131427991 | 131429531 | 1,540 | gain | 1808 | NTM | N | 0 | 6 | 8.91 | Intron+ve, ASD > 4, Normals < 2, no Sanger filter applied |
| 11 | 249 | 131427991 | 131429531 | 1,540 | gain | 1843 | NTM | N | 0 | 6 | 8.91 | Intron+ve, ASD > 4, Normals < 2, no Sanger filter applied |
| 11 | 249 | 131427991 | 131429531 | 1,540 | gain | 1912 | NTM | N | 0 | 6 | 8.91 | Intron+ve, ASD > 4, Normals < 2, no Sanger filter applied |
| 12 | 250 | 12422129 | 12423719 | 1,590 | loss | 1349 | LOH12CR1 | N | 0 | 8 | 11.92 | Intron+ve, ASD > 4, Normals < 2, no Sanger filter applied |
| 12 | 250 | 12422129 | 12423719 | 1,590 | loss | 1463 | LOH12CR1 | N | 0 | 8 | 11.92 | Intron+ve, ASD > 4, Normals < 2, no Sanger filter applied |
| 12 | 250 | 12422129 | 12423719 | 1,590 | loss | 1722 | LOH12CR1 | N | 0 | 8 | 11.92 | Intron+ve, ASD > 4, Normals < 2, no Sanger filter applied |
| 12 | 250 | 12422129 | 12423719 | 1,590 | loss | 1754 | LOH12CR1 | N | 0 | 8 | 11.92 | Intron+ve, ASD > 4, Normals < 2, no Sanger filter applied |
| 12 | 250 | 12422129 | 12423719 | 1,590 | loss | 1778 | LOH12CR1 | N | 0 | 8 | 11.92 | Intron+ve, ASD > 4, Normals < 2, no Sanger filter applied |
| 12 | 250 | 12422129 | 12423719 | 1,590 | loss | 1923 | LOH12CR1 | N | 0 | 8 | 11.92 | Intron+ve, ASD > 4, Normals < 2, no Sanger filter applied |
| 12 | 250 | 12422129 | 12423719 | 1,590 | loss | 1942 | LOH12CR1 | N | 0 | 8 | 11.92 | Intron+ve, ASD > 4, Normals < 2, no Sanger filter applied |
| 12 | 250 | 12422129 | 12423719 | 1,590 | loss | 2006 | LOH12CR1 | N | 0 | 8 | 11.92 | Intron+ve, ASD > 4, Normals < 2, no Sanger filter applied |
| 12 | 251 | 79721736 | 79723181 | 1,445 | loss | 1281 | LIN7A | N | 0 | 5 | 7.42 | Intron+ve, ASD > 4, Normals < 2, no Sanger filter applied |
| 12 | 251 | 79721736 | 79723181 | 1,445 | loss | 1465 | LIN7A | N | 0 | 5 | 7.42 | Intron+ve, ASD > 4, Normals < 2, no Sanger filter applied |
| 12 | 251 | 79721736 | 79723181 | 1,445 | loss | 1476 | LIN7A | N | 0 | 5 | 7.42 | Intron+ve, ASD > 4, Normals < 2, no Sanger filter applied |
| 12 | 251 | 79721736 | 79723181 | 1,445 | loss | 1511 | LIN7A | N | 0 | 5 | 7.42 | Intron+ve, ASD > 4, Normals < 2, no Sanger filter applied |
| 12 | 251 | 79721736 | 79723181 | 1,445 | loss | 1599 | LIN7A | N | 0 | 5 | 7.42 | Intron+ve, ASD > 4, Normals < 2, no Sanger filter applied |
| 12 | 252 | 100629833 | 100631726 | 1,893 | loss | 1395 | CHPT1 | N | 0 | 9 | 13.43 | Intron+ve, ASD > 4, Normals < 2, no Sanger filter applied |
| 12 | 252 | 100629833 | 100631726 | 1,893 | loss | 1422 | CHPT1 | N | 0 | 9 | 13.43 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 12 | 252 | 100629833 | 100631726 | 1,893 | loss | 1573 | CHPT1 | N | 0 | 9 | 13.43 | Intron+ve, ASD > 4, Normals < 2, no Sanger filter applied |
| 12 | 252 | 100629833 | 100631726 | 1,893 | loss | 1616 | CHPT1 | N | 0 | 9 | 13.43 | Intron+ve, ASD > 4, Normals < 2, no Sanger filter applied |
| 12 | 252 | 100629833 | 100631726 | 1,893 | loss | 1621 | CHPT1 | N | 0 | 9 | 13.43 | Intron+ve, ASD > 4, Normals < 2, no Sanger filter applied |
| 12 | 252 | 100629833 | 100631726 | 1,893 | loss | 1815 | CHPT1 | N | 0 | 9 | 13.43 | Intron+ve, ASD > 4, Normals < 2, no Sanger filter applied |
| 12 | 252 | 100629833 | 100631726 | 1,893 | loss | 1874 | CHPT1 | N | 0 | 9 | 13.43 | Intron+ve, ASD > 4, Normals < 2, no Sanger filter applied |
| 12 | 252 | 100629833 | 100631726 | 1,893 | loss | 1898 | CHPT1 | N | 0 | 9 | 13.43 | Intron+ve, ASD > 4, Normals < 2, no Sanger filter applied |
| 12 | 252 | 100629833 | 100631726 | 1,893 | loss | 1900 | CHPT1 | N | 0 | 9 | 13.43 | Intron+ve, ASD > 4, Normals < 2, no Sanger filter applied |
| 12 | 253 | 108123730 | 108126163 | 2,433 | gain | 1902 | ACACB | Y | 1 | 3 | 4.44 | Exon+ve, 5 > ASD > 1, Normals < 2, Sanger-ve |
| 12 | 253 | 108123730 | 108126163 | 2,433 | gain | 1936 | ACACB | Y | 1 | 3 | 4.44 | Exon+ve, 5 > ASD > 1, Normals < 2, Sanger-ve |
| 12 | 253 | 108123730 | 108126163 | 2,433 | gain | 1937 | ACACB | Y | 1 | 3 | 4.44 | Exon+ve, 5 > ASD > 1, Normals < 2, Sanger-ve |
| 12 | 254 | 110497697 | 110509958 | 12,261 | loss | 1443 | ATXN2 | N | 1 | 5 | 7.42 | Intron+ve, ASD > 4, Normals < 2, no Sanger filter applied |
| 12 | 254 | 110497697 | 110509958 | 12,261 | loss | 1576 | ATXN2 | N | 1 | 5 | 7.42 | Intron+ve, ASD > 4, Normals < 2, no Sanger filter applied |
| 12 | 254 | 110497697 | 110509958 | 12,261 | loss | 1604 | ATXN2 | N | 1 | 5 | 7.42 | Intron+ve, ASD > 4, Normals < 2, no Sanger filter applied |
| 12 | 254 | 110497697 | 110509958 | 12,261 | loss | 1815 | ATXN2 | N | 1 | 5 | 7.42 | Intron+ve, ASD > 4, Normals < 2, no Sanger filter applied |
| 12 | 254 | 110497697 | 110509958 | 12,261 | loss | 1854 | ATXN2 | N | 1 | 5 | 7.42 | Intron+ve, ASD > 4, Normals < 2, no Sanger filter applied |
| 12 | 255 | 119355352 | 119372494 | 17,142 | gain | 1543 | GATC, COX6A1, TRIAP1 | Y | 1 | 3 | 4.44 | Exon+ve, 5 > ASD > 1, Normals < 2, Sanger-ve |
| 12 | 255 | 119355352 | 119372494 | 17,142 | gain | 1599 | GATC, COX6A1, TRIAP1 | Y | 1 | 3 | 4.44 | Exon+ve, 5 > ASD > 1, Normals < 2, Sanger-ve |
| 12 | 255 | 119355352 | 119372494 | 17,142 | gain | 1851 | GATC, COX6A1, TRIAP1 | Y | 1 | 3 | 4.44 | Exon+ve, 5 > ASD > 1, Normals < 2, Sanger-ve |
| 12 | 256 | 131797099 | 131806639 | 9,540 | loss | 1256 | PGAM5 | Y | 1 | 2 | 2.95 | Exon+ve, 5 > ASD > 1, Normals < 2, Sanger-ve |
| 12 | 256 | 131797099 | 131806639 | 9,540 | loss | 1621 | PGAM5 | Y | 1 | 2 | 2.95 | Exon+ve, 5 > ASD > 1, Normals < 2, Sanger-ve |
| 13 | 257 | 27892889 | 27894406 | 1,517 | loss | 1299 | FLT1 | N | 0 | 8 | 11.92 | Intron+ve, ASD > 4, Normals < 2, no Sanger filter applied |
| 13 | 257 | 27892889 | 27894406 | 1,517 | loss | 1447 | FLT1 | N | 0 | 8 | 11.92 | Intron+ve, ASD > 4, Normals < 2, no Sanger filter applied |
| 13 | 257 | 27892889 | 27894406 | 1,517 | loss | 1592 | FLT1 | N | 0 | 8 | 11.92 | Intron+ve, ASD > 4, Normals < 2, no Sanger filter applied |
| 13 | 257 | 27892889 | 27894406 | 1,517 | loss | 1752 | FLT1 | N | 0 | 8 | 11.92 | Intron+ve, ASD > 4, Normals < 2, no Sanger filter applied |
| 13 | 257 | 27892889 | 27894406 | 1,517 | loss | 1779 | FLT1 | N | 0 | 8 | 11.92 | Intron+ve, ASD > 4, Normals < 2, no Sanger filter applied |
| 13 | 257 | 27892889 | 27894406 | 1,517 | loss | 1912 | FLT1 | N | 0 | 8 | 11.92 | Intron+ve, ASD > 4, Normals < 2, no Sanger filter applied |
| 13 | 257 | 27892889 | 27894406 | 1,517 | loss | 1916 | FLT1 | N | 0 | 8 | 11.92 | Intron+ve, ASD > 4, Normals < 2, no Sanger filter applied |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 13 | 257 | 27892889 | 27894406 | 1,517 | loss | 1952 | FLT1 | N | 0 | 8 | 11.92 | Intron+ve, ASD > 4, Normals < 2, no Sanger filter applied |
| 13 | 258 | 37988946 | 37992035 | 3,089 | loss | 1687 | | N | 0 | 22 | 33.47 | high OR intergenic (OR > 30) |
| 13 | 258 | 37988946 | 37992035 | 3,089 | loss | 1720 | | N | 0 | 22 | 33.47 | high OR intergenic (OR > 30) |
| 13 | 258 | 37988946 | 37992035 | 3,089 | loss | 1722 | | N | 0 | 22 | 33.47 | high OR intergenic (OR > 30) |
| 13 | 258 | 37988946 | 37992035 | 3,089 | loss | 1737 | | N | 0 | 22 | 33.47 | high OR intergenic (OR > 30) |
| 13 | 258 | 37988946 | 37992035 | 3,089 | loss | 1742 | | N | 0 | 22 | 33.47 | high OR intergenic (OR > 30) |
| 13 | 258 | 37988946 | 37992035 | 3,089 | loss | 1754 | | N | 0 | 22 | 33.47 | high OR intergenic (OR > 30) |
| 13 | 258 | 37988946 | 37992035 | 3,089 | loss | 1755 | | N | 0 | 22 | 33.47 | high OR intergenic (OR > 30) |
| 13 | 258 | 37988946 | 37992035 | 3,089 | loss | 1848 | | N | 0 | 22 | 33.47 | high OR intergenic (OR > 30) |
| 13 | 258 | 37988946 | 37992035 | 3,089 | loss | 1855 | | N | 0 | 22 | 33.47 | high OR intergenic (OR > 30) |
| 13 | 258 | 37988946 | 37992035 | 3,089 | loss | 1868 | | N | 0 | 22 | 33.47 | high OR intergenic (OR > 30) |
| 13 | 258 | 37988946 | 37992035 | 3,089 | loss | 1881 | | N | 0 | 22 | 33.47 | high OR intergenic (OR > 30) |
| 13 | 258 | 37988946 | 37992035 | 3,089 | loss | 1918 | | N | 0 | 22 | 33.47 | high OR intergenic (OR > 30) |
| 13 | 258 | 37988946 | 37992035 | 3,089 | loss | 1919 | | N | 0 | 22 | 33.47 | high OR intergenic (OR > 30) |
| 13 | 258 | 37988946 | 37992035 | 3,089 | loss | 1920 | | N | 0 | 22 | 33.47 | high OR intergenic (OR > 30) |
| 13 | 258 | 37988946 | 37992035 | 3,089 | loss | 1921 | | N | 0 | 22 | 33.47 | high OR intergenic (OR > 30) |
| 13 | 258 | 37988946 | 37992035 | 3,089 | loss | 1935 | | N | 0 | 22 | 33.47 | high OR intergenic (OR > 30) |
| 13 | 258 | 37988946 | 37992035 | 3,089 | loss | 1938 | | N | 0 | 22 | 33.47 | high OR intergenic (OR > 30) |
| 13 | 258 | 37988946 | 37992035 | 3,089 | loss | 1942 | | N | 0 | 22 | 33.47 | high OR intergenic (OR > 30) |
| 13 | 258 | 37988946 | 37992035 | 3,089 | loss | 1953 | | N | 0 | 22 | 33.47 | high OR intergenic (OR > 30) |
| 13 | 258 | 37988946 | 37992035 | 3,089 | loss | 1963 | | N | 0 | 22 | 33.47 | high OR intergenic (OR > 30) |
| 13 | 258 | 37988946 | 37992035 | 3,089 | loss | 1965 | | N | 0 | 22 | 33.47 | high OR intergenic (OR > 30) |
| 13 | 258 | 37988946 | 37992035 | 3,089 | loss | 1969 | | N | 0 | 22 | 33.47 | high OR intergenic (OR > 30) |
| 13 | 259 | 42518313 | 42593060 | 74,747 | gain | 1897 | DNAJC15 | Y | 1 | 2 | 2.95 | Exon+ve, 5 > ASD > 1, Normals < 2, Sanger−ve |
| 13 | 259 | 42518313 | 42593060 | 74,747 | gain | 1948 | DNAJC15 | Y | 1 | 2 | 2.95 | Exon+ve, 5 > ASD > 1, Normals < 2, Sanger−ve |
| 13 | 260 | 42639217 | 42687363 | 48,146 | loss | 1316 | ENOX1 | Y | 1 | 2 | 2.95 | Exon+ve, 5 > ASD > 1, Normals < 2, Sanger−ve |
| 13 | 260 | 42639217 | 42687363 | 48,146 | gain | 1897 | ENOX1 | Y | 1 | 2 | 2.95 | Exon+ve, 5 > ASD > 1, Normals < 2, Sanger−ve |
| 13 | 261 | 45637710 | 45637778 | 68 | loss | 1227 | LCP1 | N | 0 | 25 | 38.2 | Intron+ve, ASD > 4, Normals < 2, no Sanger filter applied |
| 13 | 261 | 45637710 | 45637778 | 68 | loss | 1293 | LCP1 | N | 0 | 25 | 38.2 | Intron+ve, ASD > 4, Normals < 2, no Sanger filter applied |
| 13 | 261 | 45637710 | 45637778 | 68 | loss | 1296 | LCP1 | N | 0 | 25 | 38.2 | Intron+ve, ASD > 4, Normals < 2, no Sanger filter applied |
| 13 | 261 | 45637710 | 45637778 | 68 | loss | 1297 | LCP1 | N | 0 | 25 | 38.2 | Intron+ve, ASD > 4, Normals < 2, no Sanger filter applied |
| 13 | 261 | 45637710 | 45637778 | 68 | gain | 1402 | LCP1 | N | 0 | 25 | 38.2 | Intron+ve, ASD > 4, Normals < 2, no Sanger filter applied |
| 13 | 261 | 45637710 | 45637778 | 68 | loss | 1451 | LCP1 | N | 0 | 25 | 38.2 | Intron+ve, ASD > 4, Normals < 2, no Sanger filter applied |
| 13 | 261 | 45637710 | 45637778 | 68 | loss | 1452 | LCP1 | N | 0 | 25 | 38.2 | Intron+ve, ASD > 4, Normals < 2, no Sanger filter applied |
| 13 | 261 | 45637710 | 45637778 | 68 | loss | 1657 | LCP1 | N | 0 | 25 | 38.2 | Intron+ve, ASD > 4, Normals < 2, no Sanger filter applied |
| 13 | 261 | 45637710 | 45637778 | 68 | loss | 1723 | LCP1 | N | 0 | 25 | 38.2 | Intron+ve, ASD > 4, Normals < 2, no Sanger filter applied |
| 13 | 261 | 45637710 | 45637778 | 68 | loss | 1742 | LCP1 | N | 0 | 25 | 38.2 | Intron+ve, ASD > 4, Normals < 2, no Sanger filter applied |
| 13 | 261 | 45637710 | 45637778 | 68 | loss | 1761 | LCP1 | N | 0 | 25 | 38.2 | Intron+ve, ASD > 4, Normals < 2, no Sanger filter applied |
| 13 | 261 | 45637710 | 45637778 | 68 | loss | 1839 | LCP1 | N | 0 | 25 | 38.2 | Intron+ve, ASD > 4, Normals < 2, no Sanger filter applied |
| 13 | 261 | 45637710 | 45637778 | 68 | loss | 1848 | LCP1 | N | 0 | 25 | 38.2 | Intron+ve, ASD > 4, Normals < 2, no Sanger filter applied |
| 13 | 261 | 45637710 | 45637778 | 68 | loss | 1871 | LCP1 | N | 0 | 25 | 38.2 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 13 | 261 | 45637710 | 45637778 | 68 | loss | 1893 | LCP1 | N | 0 | 25 | 38.2 | Intron+ve, ASD > 4, Normals < 2, no Sanger filter applied |
| 13 | 261 | 45637710 | 45637778 | 68 | loss | 1925 | LCP1 | N | 0 | 25 | 38.2 | Intron+ve, ASD > 4, Normals < 2, no Sanger filter applied |
| 13 | 261 | 45637710 | 45637778 | 68 | loss | 1927 | LCP1 | N | 0 | 25 | 38.2 | Intron+ve, ASD > 4, Normals < 2, no Sanger filter applied |
| 13 | 261 | 45637710 | 45637778 | 68 | loss | 1954 | LCP1 | N | 0 | 25 | 38.2 | Intron+ve, ASD > 4, Normals < 2, no Sanger filter applied |
| 13 | 261 | 45637710 | 45637778 | 68 | loss | 1956 | LCP1 | N | 0 | 25 | 38.2 | Intron+ve, ASD > 4, Normals < 2, no Sanger filter applied |
| 13 | 261 | 45637710 | 45637778 | 68 | loss | 1958 | LCP1 | N | 0 | 25 | 38.2 | Intron+ve, ASD > 4, Normals < 2, no Sanger filter applied |
| 13 | 261 | 45637710 | 45637778 | 68 | loss | 1965 | LCP1 | N | 0 | 25 | 38.2 | Intron+ve, ASD > 4, Normals < 2, no Sanger filter applied |
| 13 | 261 | 45637710 | 45637778 | 68 | loss | 1969 | LCP1 | N | 0 | 25 | 38.2 | Intron+ve, ASD > 4, Normals < 2, no Sanger filter applied |
| 13 | 261 | 45637710 | 45637778 | 68 | loss | 1970 | LCP1 | N | 0 | 25 | 38.2 | Intron+ve, ASD > 4, Normals < 2, no Sanger filter applied |
| 13 | 261 | 45637710 | 45637778 | 68 | loss | 2030 | LCP1 | N | 0 | 25 | 38.2 | Intron+ve, ASD > 4, Normals < 2, no Sanger filter applied |
| 13 | 261 | 45637710 | 45637778 | 68 | loss | 2031 | LCP1 | N | 0 | 25 | 38.2 | Intron+ve, ASD > 4, Normals < 2, no Sanger filter applied |
| 13 | 262 | 100693893 | 100695073 | 1,180 | gain | 1251 | NALCN | N | 0 | 5 | 7.42 | Intron+ve, ASD > 4, Normals < 2, no Sanger filter applied |
| 13 | 262 | 100693893 | 100695073 | 1,180 | gain | 1272 | NALCN | N | 0 | 5 | 7.42 | Intron+ve, ASD > 4, Normals < 2, no Sanger filter applied |
| 13 | 262 | 100693893 | 100695073 | 1,180 | gain | 1776 | NALCN | N | 0 | 5 | 7.42 | Intron+ve, ASD > 4, Normals < 2, no Sanger filter applied |
| 13 | 262 | 100693893 | 100695073 | 1,180 | gain | 1815 | NALCN | N | 0 | 5 | 7.42 | Intron+ve, ASD > 4, Normals < 2, no Sanger filter applied |
| 13 | 262 | 100693893 | 100695073 | 1,180 | gain | 1883 | NALCN | N | 0 | 5 | 7.42 | Intron+ve, ASD > 4, Normals < 2, no Sanger filter applied |
| 13 | 264 | 100923250 | 100931039 | 7,789 | gain | 1422 | ITGBL1 | N | 1 | 6 | 8.91 | Intron+ve, ASD > 4, Normals < 2, no Sanger filter applied |
| 13 | 264 | 100923250 | 100931039 | 7,789 | gain | 1551 | ITGBL1 | N | 1 | 6 | 8.91 | Intron+ve, ASD > 4, Normals < 2, no Sanger filter applied |
| 13 | 264 | 100923250 | 100931039 | 7,789 | gain | 1742 | ITGBL1 | N | 1 | 6 | 8.91 | Intron+ve, ASD > 4, Normals < 2, no Sanger filter applied |
| 13 | 264 | 100923250 | 100931039 | 7,789 | gain | 1753 | ITGBL1 | N | 1 | 6 | 8.91 | Intron+ve, ASD > 4, Normals < 2, no Sanger filter applied |
| 13 | 264 | 100923250 | 100931039 | 7,789 | gain | 1867 | ITGBL1 | N | 1 | 6 | 8.91 | Intron+ve, ASD > 4, Normals < 2, no Sanger filter applied |
| 13 | 264 | 100923250 | 100931039 | 7,789 | gain | 1881 | ITGBL1 | N | 1 | 6 | 8.91 | Intron+ve, ASD > 4, Normals < 2, no Sanger filter applied |
| 13 | 265 | 101217467 | 101229748 | 12,281 | gain | 1781 | FGF14 | N | 1 | 2 | 8.91 | Genic (distinct CNV-subregions); OR > 6 |
| 13 | 265 | 101217467 | 101229748 | 12,281 | gain | 1925 | FGF14 | N | 1 | 2 | 8.91 | Genic (distinct CNV-subregions); OR > 6 |
| 13 | 266 | 101524762 | 101574079 | 49,317 | loss | 1826 | FGF14 | N | 0 | 1 | 8.91 | Genic (distinct CNV-subregions); OR > 6 |
| 13 | 267 | 101574080 | 101575763 | 1,683 | loss | 1617 | FGF14 | N | 0 | 2 | 8.91 | Genic (distinct CNV-subregions); OR > 6 |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 13 | 267 | 101574080 | 101575763 | 1,683 | loss | 1826 | FGF14 | N | 0 | 2 | 8.91 | Genic (distinct CNV-subregions); OR > 6 |
| 13 | 268 | 101575764 | 101582091 | 6,327 | loss | 1826 | FGF14 | N | 0 | 1 | 8.91 | Genic (distinct CNV-subregions); OR > 6 |
| 13 | 269 | 101582092 | 101587700 | 5,608 | loss | 1597 | FGF14 | N | 0 | 2 | 8.91 | Genic (distinct CNV-subregions); OR > 6 |
| 13 | 269 | 101582092 | 101587700 | 5,608 | loss | 1826 | FGF14 | N | 0 | 2 | 8.91 | Genic (distinct CNV-subregions); OR > 6 |
| 13 | 270 | 101587701 | 101598573 | 10,872 | loss | 1826 | FGF14 | N | 0 | 1 | 8.91 | Genic (distinct CNV-subregions); OR > 6 |
| 13 | 271 | 101641002 | 101646218 | 5,216 | loss | 1954 | FGF14 | N | 0 | 1 | 8.91 | Genic (distinct CNV-subregions); OR > 6 |
| 13 | 272 | 102483043 | 102499472 | 16,429 | gain | 1308 | SLC10A2 | Y | 1 | 5 | 7.42 | Exon+ve, ASD > 4, Normals < 2, no Sanger filter applied |
| 13 | 272 | 102483043 | 102499472 | 16,429 | gain | 1320 | SLC10A2 | Y | 1 | 5 | 7.42 | Exon+ve, ASD > 4, Normals < 2, no Sanger filter applied |
| 13 | 272 | 102483043 | 102499472 | 16,429 | gain | 1521 | SLC10A2 | Y | 1 | 5 | 7.42 | Exon+ve, ASD > 4, Normals < 2, no Sanger filter applied |
| 13 | 272 | 102483043 | 102499472 | 16,429 | gain | 1580 | SLC10A2 | Y | 1 | 5 | 7.42 | Exon+ve, ASD > 4, Normals < 2, no Sanger filter applied |
| 13 | 272 | 102483043 | 102499472 | 16,429 | gain | 1826 | SLC10A2 | Y | 1 | 5 | 7.42 | Exon+ve, ASD > 4, Normals < 2, no Sanger filter applied |
| 13 | 273 | 112793058 | 112805778 | 12,720 | gain | 1418 | MCF2L | Y | 1 | 2 | 2.95 | Exon+ve, 5 > ASD > 1, Normals < 2, Sanger-ve |
| 13 | 273 | 112793058 | 112805778 | 12,720 | gain | 1471 | MCF2L | Y | 1 | 2 | 2.95 | Exon+ve, 5 > ASD > 1, Normals < 2, Sanger-ve |
| 13 | 274 | 113762090 | 113767184 | 5,094 | loss | 1956 | RASA3 | Y | 1 | 2 | 2.95 | Exon+ve, 5 > ASD > 1, Normals < 2, Sanger-ve |
| 13 | 274 | 113762090 | 113767184 | 5,094 | loss | 1958 | RASA3 | Y | 1 | 2 | 2.95 | Exon+ve, 5 > ASD > 1, Normals < 2, Sanger-ve |
| 14 | 275 | 22929952 | 22943261 | 13,309 | loss | 1537 | MYH6 | Y | 1 | 3 | 4.44 | Exon+ve, 5 > ASD > 1, Normals < 2, Sanger-ve |
| 14 | 275 | 22929952 | 22943261 | 13,309 | loss | 1669 | MYH6 | Y | 1 | 3 | 4.44 | Exon+ve, 5 > ASD > 1, Normals < 2, Sanger-ve |
| 14 | 275 | 22929952 | 22943261 | 13,309 | gain | 1945 | MYH6 | Y | 1 | 3 | 4.44 | Exon+ve, 5 > ASD > 1, Normals < 2, Sanger-ve |
| 14 | 276 | 22943262 | 22946614 | 3,352 | loss | 1537 | MYH6 | Y | 1 | 5 | 7.42 | Exon+ve, ASD > 4, Normals < 2, no Sanger filter applied |
| 14 | 276 | 22943262 | 22946614 | 3,352 | loss | 1577 | MYH6 | Y | 1 | 5 | 7.42 | Exon+ve, ASD > 4, Normals < 2, no Sanger filter applied |
| 14 | 276 | 22943262 | 22946614 | 3,352 | loss | 1669 | MYH6 | Y | 1 | 5 | 7.42 | Exon+ve, ASD > 4, Normals < 2, no Sanger filter applied |
| 14 | 276 | 22943262 | 22946614 | 3,352 | loss | 1856 | MYH6 | Y | 1 | 5 | 7.42 | Exon+ve, ASD > 4, Normals < 2, no Sanger filter applied |
| 14 | 276 | 22943262 | 22946614 | 3,352 | gain | 1945 | MYH6 | Y | 1 | 5 | 7.42 | Exon+ve, ASD > 4, Normals < 2, no Sanger filter applied |
| 14 | 277 | 22951087 | 22955470 | 4,383 | loss | 1537 | MYH7 | Y | 1 | 5 | 7.42 | Exon+ve, ASD > 4, Normals < 2, no Sanger filter applied |
| 14 | 277 | 22951087 | 22955470 | 4,383 | loss | 1669 | MYH7 | Y | 1 | 5 | 7.42 | Exon+ve, ASD > 4, Normals < 2, no Sanger filter applied |
| 14 | 277 | 22951087 | 22955470 | 4,383 | loss | 1856 | MYH7 | Y | 1 | 5 | 7.42 | Exon+ve, ASD > 4, Normals < 2, no Sanger filter applied |
| 14 | 277 | 22951087 | 22955470 | 4,383 | gain | 1945 | MYH7 | Y | 1 | 5 | 7.42 | Exon+ve, ASD > 4, Normals < 2, no Sanger filter applied |
| 14 | 277 | 22951087 | 22955470 | 4,383 | loss | 2032 | MYH7 | Y | 1 | 5 | 7.42 | Exon+ve, ASD > 4, Normals < 2, no Sanger filter applied |
| 14 | 278 | 22955471 | 22957582 | 2,111 | loss | 1537 | MIR208B, MYH7 | Y | 1 | 3 | 4.44 | Exon+ve, 5 > ASD > 1, Normals < 2, Sanger-ve |
| 14 | 278 | 22955471 | 22957582 | 2,111 | loss | 1669 | MIR208B, MYH7 | Y | 1 | 3 | 4.44 | Exon+ve, 5 > ASD > 1, Normals < 2, Sanger-ve |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 14 | 278 | 22955471 | 22957582 | 2,111 | gain | 1945 | MIR208B, MYH7 | Y | 1 | 3 | 4.44 | Exon+ve, 5 > ASD > 1, Normals < 2, Sanger−ve |
| 14 | 279 | 22957583 | 22958797 | 1,214 | loss | 1537 | MYH7 | Y | 1 | 2 | 2.95 | Exon+ve, 5 > ASD > 1, Normals < 2, Sanger−ve |
| 14 | 279 | 22957583 | 22958797 | 1,214 | loss | 1669 | MYH7 | Y | 1 | 2 | 2.95 | Exon+ve, 5 > ASD > 1, Normals < 2, Sanger−ve |
| 14 | 280 | 38866449 | 38872818 | 6,369 | loss | 1235 | CTAGE5 | N | 0 | 8 | 11.92 | Intron+ve, ASD > 4, Normals < 2, no Sanger filter applied |
| 14 | 280 | 38866449 | 38872818 | 6,369 | loss | 1237 | CTAGE5 | N | 0 | 8 | 11.92 | Intron+ve, ASD > 4, Normals < 2, no Sanger filter applied |
| 14 | 280 | 38866449 | 38872818 | 6,369 | loss | 1526 | CTAGE5 | N | 0 | 8 | 11.92 | Intron+ve, ASD > 4, Normals < 2, no Sanger filter applied |
| 14 | 280 | 38866449 | 38872818 | 6,369 | loss | 1541 | CTAGE5 | N | 0 | 8 | 11.92 | Intron+ve, ASD > 4, Normals < 2, no Sanger filter applied |
| 14 | 280 | 38866449 | 38872818 | 6,369 | loss | 1609 | CTAGE5 | N | 0 | 8 | 11.92 | Intron+ve, ASD > 4, Normals < 2, no Sanger filter applied |
| 14 | 280 | 38866449 | 38872818 | 6,369 | loss | 1819 | CTAGE5 | N | 0 | 8 | 11.92 | Intron+ve, ASD > 4, Normals < 2, no Sanger filter applied |
| 14 | 280 | 38866449 | 38872818 | 6,369 | loss | 1915 | CTAGE5 | N | 0 | 8 | 11.92 | Intron+ve, ASD > 4, Normals < 2, no Sanger filter applied |
| 14 | 280 | 38866449 | 38872818 | 6,369 | loss | 2027 | CTAGE5 | N | 0 | 8 | 11.92 | Intron+ve, ASD > 4, Normals < 2, no Sanger filter applied |
| 14 | 281 | 38872819 | 38872944 | 125 | loss | 1235 | CTAGE5 | N | 0 | 6 | 8.91 | Intron+ve, ASD > 4, Normals < 2, no Sanger filter applied |
| 14 | 281 | 38872819 | 38872944 | 125 | loss | 1526 | CTAGE5 | N | 0 | 6 | 8.91 | Intron+ve, ASD > 4, Normals < 2, no Sanger filter applied |
| 14 | 281 | 38872819 | 38872944 | 125 | loss | 1541 | CTAGE5 | N | 0 | 6 | 8.91 | Intron+ve, ASD > 4, Normals < 2, no Sanger filter applied |
| 14 | 281 | 38872819 | 38872944 | 125 | loss | 1609 | CTAGE5 | N | 0 | 6 | 8.91 | Intron+ve, ASD > 4, Normals < 2, no Sanger filter applied |
| 14 | 281 | 38872819 | 38872944 | 125 | loss | 1819 | CTAGE5 | N | 0 | 6 | 8.91 | Intron+ve, ASD > 4, Normals < 2, no Sanger filter applied |
| 14 | 281 | 38872819 | 38872944 | 125 | loss | 2027 | CTAGE5 | N | 0 | 6 | 8.91 | Intron+ve, ASD > 4, Normals < 2, no Sanger filter applied |
| 14 | 282 | 46774115 | 46778734 | 4,619 | loss | 1609 | MDGA2 | N | 0 | 5 | 7.42 | Intron+ve, ASD > 4, Normals < 2, no Sanger filter applied |
| 14 | 282 | 46774115 | 46778734 | 4,619 | loss | 1666 | MDGA2 | N | 0 | 5 | 7.42 | Intron+ve, ASD > 4, Normals < 2, no Sanger filter applied |
| 14 | 282 | 46774115 | 46778734 | 4,619 | loss | 1693 | MDGA2 | N | 0 | 5 | 7.42 | Intron+ve, ASD > 4, Normals < 2, no Sanger filter applied |
| 14 | 282 | 46774115 | 46778734 | 4,619 | loss | 1729 | MDGA2 | N | 0 | 5 | 7.42 | Intron+ve, ASD > 4, Normals < 2, no Sanger filter applied |
| 14 | 282 | 46774115 | 46778734 | 4,619 | loss | 1850 | MDGA2 | N | 0 | 5 | 7.42 | Intron+ve, ASD > 4, Normals < 2, no Sanger filter applied |
| 14 | 283 | 69092212 | 69093444 | 1,232 | loss | 1401 | | N | 0 | 22 | 33.47 | high OR intergenic (OR > 30) |
| 14 | 283 | 69092212 | 69093444 | 1,232 | loss | 1465 | | N | 0 | 22 | 33.47 | high OR intergenic (OR > 30) |
| 14 | 283 | 69092212 | 69093444 | 1,232 | loss | 1704 | | N | 0 | 22 | 33.47 | high OR intergenic (OR > 30) |
| 14 | 283 | 69092212 | 69093444 | 1,232 | loss | 1710 | | N | 0 | 22 | 33.47 | high OR intergenic (OR > 30) |
| 14 | 283 | 69092212 | 69093444 | 1,232 | loss | 1722 | | N | 0 | 22 | 33.47 | high OR intergenic (OR > 30) |
| 14 | 283 | 69092212 | 69093444 | 1,232 | loss | 1723 | | N | 0 | 22 | 33.47 | high OR intergenic (OR > 30) |
| 14 | 283 | 69092212 | 69093444 | 1,232 | loss | 1751 | | N | 0 | 22 | 33.47 | high OR intergenic (OR > 30) |
| 14 | 283 | 69092212 | 69093444 | 1,232 | loss | 1752 | | N | 0 | 22 | 33.47 | high OR intergenic (OR > 30) |
| 14 | 283 | 69092212 | 69093444 | 1,232 | loss | 1754 | | N | 0 | 22 | 33.47 | high OR intergenic (OR > 30) |
| 14 | 283 | 69092212 | 69093444 | 1,232 | loss | 1761 | | N | 0 | 22 | 33.47 | high OR intergenic (OR > 30) |
| 14 | 283 | 69092212 | 69093444 | 1,232 | loss | 1763 | | N | 0 | 22 | 33.47 | high OR intergenic (OR > 30) |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 14 | 283 | 69092212 | 69093444 | 1,232 | loss | 1778 | | N | 0 | 22 | 33.47 | high OR intergenic (OR > 30) |
| 14 | 283 | 69092212 | 69093444 | 1,232 | loss | 1797 | | N | 0 | 22 | 33.47 | high OR intergenic (OR > 30) |
| 14 | 283 | 69092212 | 69093444 | 1,232 | loss | 1814 | | N | 0 | 22 | 33.47 | high OR intergenic (OR > 30) |
| 14 | 283 | 69092212 | 69093444 | 1,232 | loss | 1833 | | N | 0 | 22 | 33.47 | high OR intergenic (OR > 30) |
| 14 | 283 | 69092212 | 69093444 | 1,232 | loss | 1848 | | N | 0 | 22 | 33.47 | high OR intergenic (OR > 30) |
| 14 | 283 | 69092212 | 69093444 | 1,232 | loss | 1852 | | N | 0 | 22 | 33.47 | high OR intergenic (OR > 30) |
| 14 | 283 | 69092212 | 69093444 | 1,232 | loss | 1853 | | N | 0 | 22 | 33.47 | high OR intergenic (OR > 30) |
| 14 | 283 | 69092212 | 69093444 | 1,232 | loss | 1855 | | N | 0 | 22 | 33.47 | high OR intergenic (OR > 30) |
| 14 | 283 | 69092212 | 69093444 | 1,232 | loss | 1881 | | N | 0 | 22 | 33.47 | high OR intergenic (OR > 30) |
| 14 | 283 | 69092212 | 69093444 | 1,232 | loss | 1897 | | N | 0 | 22 | 33.47 | high OR intergenic (OR > 30) |
| 14 | 283 | 69092212 | 69093444 | 1,232 | loss | 1945 | | N | 0 | 22 | 33.47 | high OR intergenic (OR > 30) |
| 14 | 284 | 73060301 | 73061941 | 1,640 | loss | 1237 | HEATR4 | N | 0 | 15 | 22.58 | Intron+ve, ASD > 4, Normals < 2, no Sanger filter applied |
| 14 | 284 | 73060301 | 73061941 | 1,640 | loss | 1238 | HEATR4 | N | 0 | 15 | 22.58 | Intron+ve, ASD > 4, Normals < 2, no Sanger filter applied |
| 14 | 284 | 73060301 | 73061941 | 1,640 | gain | 1291 | HEATR4 | N | 0 | 15 | 22.58 | Intron+ve, ASD > 4, Normals < 2, no Sanger filter applied |
| 14 | 284 | 73060301 | 73061941 | 1,640 | loss | 1574 | HEATR4 | N | 0 | 15 | 22.58 | Intron+ve, ASD > 4, Normals < 2, no Sanger filter applied |
| 14 | 284 | 73060301 | 73061941 | 1,640 | loss | 1672 | HEATR4 | N | 0 | 15 | 22.58 | Intron+ve, ASD > 4, Normals < 2, no Sanger filter applied |
| 14 | 284 | 73060301 | 73061941 | 1,640 | loss | 1676 | HEATR4 | N | 0 | 15 | 22.58 | Intron+ve, ASD > 4, Normals < 2, no Sanger filter applied |
| 14 | 284 | 73060301 | 73061941 | 1,640 | loss | 1687 | HEATR4 | N | 0 | 15 | 22.58 | Intron+ve, ASD > 4, Normals < 2, no Sanger filter applied |
| 14 | 284 | 73060301 | 73061941 | 1,640 | loss | 1718 | HEATR4 | N | 0 | 15 | 22.58 | Intron+ve, ASD > 4, Normals < 2, no Sanger filter applied |
| 14 | 284 | 73060301 | 73061941 | 1,640 | loss | 1720 | HEATR4 | N | 0 | 15 | 22.58 | Intron+ve, ASD > 4, Normals < 2, no Sanger filter applied |
| 14 | 284 | 73060301 | 73061941 | 1,640 | loss | 1721 | HEATR4 | N | 0 | 15 | 22.58 | Intron+ve, ASD > 4, Normals < 2, no Sanger filter applied |
| 14 | 284 | 73060301 | 73061941 | 1,640 | loss | 1723 | HEATR4 | N | 0 | 15 | 22.58 | Intron+ve, ASD > 4, Normals < 2, no Sanger filter applied |
| 14 | 284 | 73060301 | 73061941 | 1,640 | loss | 1760 | HEATR4 | N | 0 | 15 | 22.58 | Intron+ve, ASD > 4, Normals < 2, no Sanger filter applied |
| 14 | 284 | 73060301 | 73061941 | 1,640 | loss | 1862 | HEATR4 | N | 0 | 15 | 22.58 | Intron+ve, ASD > 4, Normals < 2, no Sanger filter applied |
| 14 | 284 | 73060301 | 73061941 | 1,640 | loss | 1916 | HEATR4 | N | 0 | 15 | 22.58 | Intron+ve, ASD > 4, Normals < 2, no Sanger filter applied |
| 14 | 284 | 73060301 | 73061941 | 1,640 | loss | 2003 | HEATR4 | N | 0 | 15 | 22.58 | Intron+ve, ASD > 4, Normals < 2, no Sanger filter applied |
| 14 | 285 | 73061943 | 73071403 | 9,460 | loss | 1232 | HEATR4 | N | 0 | 27 | 41.39 | Intron+ve, ASD > 4, Normals < 2, no Sanger filter applied |
| 14 | 285 | 73061943 | 73071403 | 9,460 | loss | 1233 | HEATR4 | N | 0 | 27 | 41.39 | Intron+ve, ASD > 4, Normals < 2, no Sanger filter applied |
| 14 | 285 | 73061943 | 73071403 | 9,460 | loss | 1237 | HEATR4 | N | 0 | 27 | 41.39 | Intron+ve, ASD > 4, Normals < 2, no Sanger filter applied |
| 14 | 285 | 73061943 | 73071403 | 9,460 | loss | 1238 | HEATR4 | N | 0 | 27 | 41.39 | Intron+ve, ASD > 4, Normals < 2, no Sanger filter applied |
| 14 | 285 | 73061943 | 73071403 | 9,460 | gain | 1291 | HEATR4 | N | 0 | 27 | 41.39 | Intron+ve, ASD > 4, Normals < 2, no Sanger filter applied |
| 14 | 285 | 73061943 | 73071403 | 9,460 | loss | 1574 | HEATR4 | N | 0 | 27 | 41.39 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 14 | 285 | 73061943 | 73071403 | 9,460 | loss | 1672 | HEATR4 | N | 0 | 27 | 41.39 | Intron+ve, ASD > 4, Normals < 2, no Sanger filter applied |
| 14 | 285 | 73061943 | 73071403 | 9,460 | loss | 1687 | HEATR4 | N | 0 | 27 | 41.39 | Intron+ve, ASD > 4, Normals < 2, no Sanger filter applied |
| 14 | 285 | 73061943 | 73071403 | 9,460 | loss | 1718 | HEATR4 | N | 0 | 27 | 41.39 | Intron+ve, ASD > 4, Normals < 2, no Sanger filter applied |
| 14 | 285 | 73061943 | 73071403 | 9,460 | loss | 1720 | HEATR4 | N | 0 | 27 | 41.39 | Intron+ve, ASD > 4, Normals < 2, no Sanger filter applied |
| 14 | 285 | 73061943 | 73071403 | 9,460 | loss | 1721 | HEATR4 | N | 0 | 27 | 41.39 | Intron+ve, ASD > 4, Normals < 2, no Sanger filter applied |
| 14 | 285 | 73061943 | 73071403 | 9,460 | loss | 1723 | HEATR4 | N | 0 | 27 | 41.39 | Intron+ve, ASD > 4, Normals < 2, no Sanger filter applied |
| 14 | 285 | 73061943 | 73071403 | 9,460 | loss | 1760 | HEATR4 | N | 0 | 27 | 41.39 | Intron+ve, ASD > 4, Normals < 2, no Sanger filter applied |
| 14 | 285 | 73061943 | 73071403 | 9,460 | loss | 1773 | HEATR4 | N | 0 | 27 | 41.39 | Intron+ve, ASD > 4, Normals < 2, no Sanger filter applied |
| 14 | 285 | 73061943 | 73071403 | 9,460 | loss | 1779 | HEATR4 | N | 0 | 27 | 41.39 | Intron+ve, ASD > 4, Normals < 2, no Sanger filter applied |
| 14 | 285 | 73061943 | 73071403 | 9,460 | loss | 1800 | HEATR4 | N | 0 | 27 | 41.39 | Intron+ve, ASD > 4, Normals < 2, no Sanger filter applied |
| 14 | 285 | 73061943 | 73071403 | 9,460 | loss | 1837 | HEATR4 | N | 0 | 27 | 41.39 | Intron+ve, ASD > 4, Normals < 2, no Sanger filter applied |
| 14 | 285 | 73061943 | 73071403 | 9,460 | loss | 1862 | HEATR4 | N | 0 | 27 | 41.39 | Intron+ve, ASD > 4, Normals < 2, no Sanger filter applied |
| 14 | 285 | 73061943 | 73071403 | 9,460 | loss | 1871 | HEATR4 | N | 0 | 27 | 41.39 | Intron+ve, ASD > 4, Normals < 2, no Sanger filter applied |
| 14 | 285 | 73061943 | 73071403 | 9,460 | loss | 1916 | HEATR4 | N | 0 | 27 | 41.39 | Intron+ve, ASD > 4, Normals < 2, no Sanger filter applied |
| 14 | 285 | 73061943 | 73071403 | 9,460 | loss | 1917 | HEATR4 | N | 0 | 27 | 41.39 | Intron+ve, ASD > 4, Normals < 2, no Sanger filter applied |
| 14 | 285 | 73061943 | 73071403 | 9,460 | loss | 1943 | HEATR4 | N | 0 | 27 | 41.39 | Intron+ve, ASD > 4, Normals < 2, no Sanger filter applied |
| 14 | 285 | 73061943 | 73071403 | 9,460 | loss | 1948 | HEATR4 | N | 0 | 27 | 41.39 | Intron+ve, ASD > 4, Normals < 2, no Sanger filter applied |
| 14 | 285 | 73061943 | 73071403 | 9,460 | loss | 1967 | HEATR4 | N | 0 | 27 | 41.39 | Intron+ve, ASD > 4, Normals < 2, no Sanger filter applied |
| 14 | 285 | 73061943 | 73071403 | 9,460 | loss | 2003 | HEATR4 | N | 0 | 27 | 41.39 | Intron+ve, ASD > 4, Normals < 2, no Sanger filter applied |
| 14 | 285 | 73061943 | 73071403 | 9,460 | loss | 2005 | HEATR4 | N | 0 | 27 | 41.39 | Intron+ve, ASD > 4, Normals < 2, no Sanger filter applied |
| 14 | 285 | 73061943 | 73071403 | 9,460 | loss | 2041 | HEATR4 | N | 0 | 27 | 41.39 | Intron+ve, ASD > 4, Normals < 2, no Sanger filter applied |
| 14 | 286 | 80413494 | 80429808 | 16,314 | loss | 1293 | C14orf145 | N | 0 | 6 | 8.91 | Intron+ve, ASD > 4, Normals < 2, no Sanger filter applied |
| 14 | 286 | 80413494 | 80429808 | 16,314 | gain | 1324 | C14orf145 | N | 0 | 6 | 8.91 | Intron+ve, ASD > 4, Normals < 2, no Sanger filter applied |
| 14 | 286 | 80413494 | 80429808 | 16,314 | loss | 1844 | C14orf145 | N | 0 | 6 | 8.91 | Intron+ve, ASD > 4, Normals < 2, no Sanger filter applied |
| 14 | 286 | 80413494 | 80429808 | 16,314 | loss | 1916 | C14orf145 | N | 0 | 6 | 8.91 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 14 | 286 | 80413494 | 80429808 | 16,314 | loss | 1957 | C14orf145 | N | 0 | 6 | 8.91 | Intron+ve, ASD > 4, Normals < 2, no Sanger filter applied |
| 14 | 286 | 80413494 | 80429808 | 16,314 | loss | 1961 | C14orf145 | N | 0 | 6 | 8.91 | Intron+ve, ASD > 4, Normals < 2, no Sanger filter applied |
| 14 | 287 | 90323329 | 90324694 | 1,365 | loss | 1279 | TTC7B | N | 0 | 8 | 11.92 | Intron+ve, ASD > 4, Normals < 2, no Sanger filter applied |
| 14 | 287 | 90323329 | 90324694 | 1,365 | loss | 1287 | TTC7B | N | 0 | 8 | 11.92 | Intron+ve, ASD > 4, Normals < 2, no Sanger filter applied |
| 14 | 287 | 90323329 | 90324694 | 1,365 | gain | 1298 | TTC7B | N | 0 | 8 | 11.92 | Intron+ve, ASD > 4, Normals < 2, no Sanger filter applied |
| 14 | 287 | 90323329 | 90324694 | 1,365 | loss | 1559 | TTC7B | N | 0 | 8 | 11.92 | Intron+ve, ASD > 4, Normals < 2, no Sanger filter applied |
| 14 | 287 | 90323329 | 90324694 | 1,365 | loss | 1647 | TTC7B | N | 0 | 8 | 11.92 | Intron+ve, ASD > 4, Normals < 2, no Sanger filter applied |
| 14 | 287 | 90323329 | 90324694 | 1,365 | loss | 1786 | TTC7B | N | 0 | 8 | 11.92 | Intron+ve, ASD > 4, Normals < 2, no Sanger filter applied |
| 14 | 287 | 90323329 | 90324694 | 1,365 | loss | 1794 | TTC7B | N | 0 | 8 | 11.92 | Intron+ve, ASD > 4, Normals < 2, no Sanger filter applied |
| 14 | 287 | 90323329 | 90324694 | 1,365 | loss | 1891 | TTC7B | N | 0 | 8 | 11.92 | Intron+ve, ASD > 4, Normals < 2, no Sanger filter applied |
| 14 | 288 | 104679956 | 104686612 | 6,656 | gain | 1447 | JAG2 | Y | 1 | 3 | 4.44 | Exon+ve, 5 > ASD > 1, Normals < 2, Sanger−ve |
| 14 | 288 | 104679956 | 104686612 | 6,656 | loss | 1695 | JAG2 | Y | 1 | 3 | 4.44 | Exon+ve, 5 > ASD > 1, Normals < 2, Sanger−ve |
| 14 | 288 | 104679956 | 104686612 | 6,656 | loss | 1739 | JAG2 | Y | 1 | 3 | 4.44 | Exon+ve, 5 > ASD > 1, Normals < 2, Sanger−ve |
| 14 | 289 | 104686613 | 104688434 | 1,821 | gain | 1447 | JAG2 | Y | 1 | 4 | 5.92 | Exon+ve, 5 > ASD > 1, Normals < 2, Sanger−ve |
| 14 | 289 | 104686613 | 104688434 | 1,821 | loss | 1695 | JAG2 | Y | 1 | 4 | 5.92 | Exon+ve, 5 > ASD > 1, Normals < 2, Sanger−ve |
| 14 | 289 | 104686613 | 104688434 | 1,821 | loss | 1739 | JAG2 | Y | 1 | 4 | 5.92 | Exon+ve, 5 > ASD > 1, Normals < 2, Sanger−ve |
| 14 | 289 | 104686613 | 104688434 | 1,821 | loss | 1856 | JAG2 | Y | 1 | 4 | 5.92 | Exon+ve, 5 > ASD > 1, Normals < 2, Sanger−ve |
| 14 | 290 | 104902380 | 104905434 | 3,054 | gain | 1447 | PACS2 | Y | 1 | 2 | 2.95 | Exon+ve, 5 > ASD > 1, Normals < 2, Sanger−ve |
| 14 | 290 | 104902380 | 104905434 | 3,054 | loss | 2036 | PACS2 | Y | 1 | 2 | 2.95 | Exon+ve, 5 > ASD > 1, Normals < 2, Sanger−ve |
| 15 | 291 | 20760284 | 21205712 | 445,428 | gain | 1333 | GOLGA8E, GOLGA8IP, HERC2P2, HERC2P7 | Y | 0 | 7 | 10.41 | Exon+ve, ASD > 4, Normals < 2, no Sanger filter applied |
| 15 | 291 | 20760284 | 21205712 | 445,428 | loss | 1564 | GOLGA8E, GOLGA8IP, HERC2P2, HERC2P7 | Y | 0 | 7 | 10.41 | Exon+ve, ASD > 4, Normals < 2, no Sanger filter applied |
| 15 | 291 | 20760284 | 21205712 | 445,428 | loss | 1761 | GOLGA8E, GOLGA8IP, HERC2P2, HERC2P7 | Y | 0 | 7 | 10.41 | Exon+ve, ASD > 4, Normals < 2, no Sanger filter applied |
| 15 | 291 | 20760284 | 21205712 | 445,428 | loss | 1799 | GOLGA8E, GOLGA8IP, HERC2P2, HERC2P7 | Y | 0 | 7 | 10.41 | Exon+ve, ASD > 4, Normals < 2, no Sanger filter applied |
| 15 | 291 | 20760284 | 21205712 | 445,428 | loss | 1839 | GOLGA8E, GOLGA8IP, HERC2P2, HERC2P7 | Y | 0 | 7 | 10.41 | Exon+ve, ASD > 4, Normals < 2, no Sanger filter applied |
| 15 | 291 | 20760284 | 21205712 | 445,428 | loss | 1948 | GOLGA8E, GOLGA8IP, HERC2P2, HERC2P7 | Y | 0 | 7 | 10.41 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 15 | 291 | 20760284 | 21205712 | 445,428 | gain | 1951 | GOLGA8E, GOLGA8IP, HERC2P2, HERC2P7 | Y | 0 | 7 | 10.41 | Exon+ve, ASD > 4, Normals < 2, no Sanger filter applied |
| 15 | 291 | 27028094 | 27115748 | 87,654 | gain | 1988 | APBA2 | Y | 1 | 2 | 2.95 | Exon+ve, 5 > ASD > 1, Normals < 2, Sanger−ve |
| 15 | 291 | 27028094 | 27115748 | 87,654 | loss | 1994 | APBA2 | Y | 1 | 2 | 2.95 | Exon+ve, 5 > ASD > 1, Normals < 2, Sanger−ve |
| 15 | 292 | 32456500 | 32514938 | 58,438 | loss | 1245 | MIR1233-1, GOLGA8A, MIR1233-2, | Y | 1 | 9 | 13.43 | Exon+ve, ASD > 4, Normals < 2, no Sanger filter applied |
| 15 | 292 | 32456500 | 32514938 | 58,438 | loss | 1317 | MIR1233-1, GOLGA8A, MIR1233-2, | Y | 1 | 9 | 13.43 | Exon+ve, ASD > 4, Normals < 2, no Sanger filter applied |
| 15 | 292 | 32456500 | 32514938 | 58,438 | loss | 1440 | MIR1233-1, GOLGA8A, MIR1233-2, | Y | 1 | 9 | 13.43 | Exon+ve, ASD > 4, Normals < 2, no Sanger filter applied |
| 15 | 292 | 32456500 | 32514938 | 58,438 | loss | 1449 | MIR1233-1, GOLGA8A, MIR1233-2, | Y | 1 | 9 | 13.43 | Exon+ve, ASD > 4, Normals < 2, no Sanger filter applied |
| 15 | 292 | 32456500 | 32514938 | 58,438 | loss | 1467 | MIR1233-1, GOLGA8A, MIR1233-2, | Y | 1 | 9 | 13.43 | Exon+ve, ASD > 4, Normals < 2, no Sanger filter applied |
| 15 | 292 | 32456500 | 32514938 | 58,438 | loss | 1724 | MIR1233-1, GOLGA8A, MIR1233-2, | Y | 1 | 9 | 13.43 | Exon+ve, ASD > 4, Normals < 2, no Sanger filter applied |
| 15 | 292 | 32456500 | 32514938 | 58,438 | loss | 1829 | MIR1233-1, GOLGA8A, MIR1233-2, | Y | 1 | 9 | 13.43 | Exon+ve, ASD > 4, Normals < 2, no Sanger filter applied |
| 15 | 292 | 32456500 | 32514938 | 58,438 | loss | 1935 | MIR1233-1, GOLGA8A, MIR1233-2, | Y | 1 | 9 | 13.43 | Exon+ve, ASD > 4, Normals < 2, no Sanger filter applied |
| 15 | 292 | 32456500 | 32514938 | 58,438 | loss | 2041 | MIR1233-1, GOLGA8A, MIR1233-2, | Y | 1 | 9 | 13.43 | Exon+ve, ASD > 4, Normals < 2, no Sanger filter applied |
| 15 | 293 | 52519074 | 52533227 | 14,153 | loss | 1260 | UNC13C | N | 1 | 5 | 7.42 | Intron+ve, ASD > 4, Normals < 2, no Sanger filter applied |
| 15 | 293 | 52519074 | 52533227 | 14,153 | loss | 1451 | UNC13C | N | 1 | 5 | 7.42 | Intron+ve, ASD > 4, Normals < 2, no Sanger filter applied |
| 15 | 293 | 52519074 | 52533227 | 14,153 | loss | 1670 | UNC13C | N | 1 | 5 | 7.42 | Intron+ve, ASD > 4, Normals < 2, no Sanger filter applied |
| 15 | 293 | 52519074 | 52533227 | 14,153 | loss | 1672 | UNC13C | N | 1 | 5 | 7.42 | Intron+ve, ASD > 4, Normals < 2, no Sanger filter applied |
| 15 | 293 | 52519074 | 52533227 | 14,153 | loss | 1741 | UNC13C | N | 1 | 5 | 7.42 | Intron+ve, ASD > 4, Normals < 2, no Sanger filter applied |
| 15 | 294 | 56036057 | 56039530 | 3,473 | loss | 1233 | ALDH1A2 | N | 1 | 9 | 13.43 | Intron+ve, ASD > 4, Normals < 2, no Sanger filter applied |
| 15 | 294 | 56036057 | 56039530 | 3,473 | loss | 1371 | ALDH1A2 | N | 1 | 9 | 13.43 | Intron+ve, ASD > 4, Normals < 2, no Sanger filter applied |
| 15 | 294 | 56036057 | 56039530 | 3,473 | loss | 1402 | ALDH1A2 | N | 1 | 9 | 13.43 | Intron+ve, ASD > 4, Normals < 2, no Sanger filter applied |
| 15 | 294 | 56036057 | 56039530 | 3,473 | loss | 1407 | ALDH1A2 | N | 1 | 9 | 13.43 | Intron+ve, ASD > 4, Normals < 2, no Sanger filter applied |
| 15 | 294 | 56036057 | 56039530 | 3,473 | loss | 1464 | ALDH1A2 | N | 1 | 9 | 13.43 | Intron+ve, ASD > 4, Normals < 2, no Sanger filter applied |
| 15 | 294 | 56036057 | 56039530 | 3,473 | loss | 1519 | ALDH1A2 | N | 1 | 9 | 13.43 | Intron+ve, ASD > 4, Normals < 2, no Sanger filter applied |
| 15 | 294 | 56036057 | 56039530 | 3,473 | loss | 1602 | ALDH1A2 | N | 1 | 9 | 13.43 | Intron+ve, ASD > 4, Normals < 2, no Sanger filter applied |
| 15 | 294 | 56036057 | 56039530 | 3,473 | loss | 1680 | ALDH1A2 | N | 1 | 9 | 13.43 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 15 | 294 | 56036057 | 56039530 | 3,473 | loss | 1902 | ALDH1A2 | N | 1 | 9 | 13.43 | Intron+ve, ASD > 4, Normals < 2, no Sanger filter applied |
| 15 | 295 | 69027858 | 69034501 | 6,643 | loss | 1308 | LRRC49 | N | 1 | 8 | 11.92 | Intron+ve, ASD > 4, Normals < 2, no Sanger filter applied |
| 15 | 295 | 69027858 | 69034501 | 6,643 | loss | 1309 | LRRC49 | N | 1 | 8 | 11.92 | Intron+ve, ASD > 4, Normals < 2, no Sanger filter applied |
| 15 | 295 | 69027858 | 69034501 | 6,643 | loss | 1420 | LRRC49 | N | 1 | 8 | 11.92 | Intron+ve, ASD > 4, Normals < 2, no Sanger filter applied |
| 15 | 295 | 69027858 | 69034501 | 6,643 | loss | 1422 | LRRC49 | N | 1 | 8 | 11.92 | Intron+ve, ASD > 4, Normals < 2, no Sanger filter applied |
| 15 | 295 | 69027858 | 69034501 | 6,643 | loss | 1432 | LRRC49 | N | 1 | 8 | 11.92 | Intron+ve, ASD > 4, Normals < 2, no Sanger filter applied |
| 15 | 295 | 69027858 | 69034501 | 6,643 | loss | 1434 | LRRC49 | N | 1 | 8 | 11.92 | Intron+ve, ASD > 4, Normals < 2, no Sanger filter applied |
| 15 | 295 | 69027858 | 69034501 | 6,643 | loss | 1447 | LRRC49 | N | 1 | 8 | 11.92 | Intron+ve, ASD > 4, Normals < 2, no Sanger filter applied |
| 15 | 295 | 69027858 | 69034501 | 6,643 | gain | 1565 | LRRC49 | N | 1 | 8 | 11.92 | Intron+ve, ASD > 4, Normals < 2, no Sanger filter applied |
| 15 | 296 | 73684637 | 73686655 | 2,018 | loss | 1415 | SNUPN | Y | 1 | 3 | 4.44 | Exon+ve, 5 > ASD > 1, Normals < 2, Sanger-ve |
| 15 | 296 | 73684637 | 73686655 | 2,018 | loss | 1773 | SNUPN | Y | 1 | 3 | 4.44 | Exon+ve, 5 > ASD > 1, Normals < 2, Sanger-ve |
| 15 | 296 | 73684637 | 73686655 | 2,018 | gain | 2018 | SNUPN | Y | 1 | 3 | 4.44 | Exon+ve, 5 > ASD > 1, Normals < 2, Sanger-ve |
| 15 | 297 | 73686656 | 73690130 | 3,474 | loss | 1415 | SNUPN | Y | 1 | 2 | 2.95 | Exon+ve, 5 > ASD > 1, Normals < 2, Sanger-ve |
| 15 | 297 | 73686656 | 73690130 | 3,474 | gain | 2018 | SNUPN | Y | 1 | 2 | 2.95 | Exon+ve, 5 > ASD > 1, Normals < 2, Sanger-ve |
| 15 | 298 | 73729296 | 73759785 | 30,489 | loss | 1415 | SNX33, CSPG4 | Y | 1 | 2 | 2.95 | Exon+ve, 5 > ASD > 1, Normals < 2, Sanger-ve |
| 15 | 298 | 73729296 | 73759785 | 30,489 | gain | 2018 | SNX33, CSPG4 | Y | 1 | 2 | 2.95 | Exon+ve, 5 > ASD > 1, Normals < 2, Sanger-ve |
| 15 | 299 | 76206143 | 76220301 | 14,158 | gain | 1300 | CIB2 | Y | 1 | 2 | 2.95 | Exon+ve, 5 > ASD > 1, Normals < 2, Sanger-ve |
| 15 | 299 | 76206143 | 76220301 | 14,158 | gain | 1918 | CIB2 | Y | 1 | 2 | 2.95 | Exon+ve, 5 > ASD > 1, Normals < 2, Sanger-ve |
| 15 | 300 | 99976057 | 100033499 | 57,442 | gain | 1370 | TM2D3, TARSL2 | Y | 1 | 3 | 4.44 | Exon+ve, 5 > ASD > 1, Normals < 2, Sanger-ve |
| 15 | 300 | 99976057 | 100033499 | 57,442 | gain | 1907 | TM2D3, TARSL2 | Y | 1 | 3 | 4.44 | Exon+ve, 5 > ASD > 1, Normals < 2, Sanger-ve |
| 15 | 300 | 99976057 | 100033499 | 57,442 | gain | 1947 | TM2D3, TARSL2 | Y | 1 | 3 | 4.44 | Exon+ve, 5 > ASD > 1, Normals < 2, Sanger-ve |
| 16 | 301 | 386962 | 388480 | 1,518 | loss | 1248 | NME4 | Y | 1 | 4 | 5.92 | Exon+ve, 5 > ASD > 1, Normals < 2, Sanger-ve |
| 16 | 301 | 386962 | 388480 | 1,518 | loss | 1758 | NME4 | Y | 1 | 4 | 5.92 | Exon+ve, 5 > ASD > 1, Normals < 2, Sanger-ve |
| 16 | 301 | 386962 | 388480 | 1,518 | loss | 1810 | NME4 | Y | 1 | 4 | 5.92 | Exon+ve, 5 > ASD > 1, Normals < 2, Sanger-ve |
| 16 | 301 | 386962 | 388480 | 1,518 | loss | 1865 | NME4 | Y | 1 | 4 | 5.92 | Exon+ve, 5 > ASD > 1, Normals < 2, Sanger-ve |
| 16 | 302 | 759120 | 764070 | 4,950 | loss | 1242 | MIR662, MSLNL | Y | 4 | 31 | 11.92 | Genic (distinct CNV-subregions); OR > 6 |
| 16 | 302 | 759120 | 764070 | 4,950 | loss | 1257 | MIR662, MSLNL | Y | 4 | 31 | 11.92 | Genic (distinct CNV-subregions); OR > 6 |
| 16 | 302 | 759120 | 764070 | 4,950 | loss | 1282 | MIR662, MSLNL | Y | 4 | 31 | 11.92 | Genic (distinct CNV-subregions); OR > 6 |
| 16 | 302 | 759120 | 764070 | 4,950 | loss | 1344 | MIR662, MSLNL | Y | 4 | 31 | 11.92 | Genic (distinct CNV-subregions); OR > 6 |
| 16 | 302 | 759120 | 764070 | 4,950 | loss | 1346 | MIR662, MSLNL | Y | 4 | 31 | 11.92 | Genic (distinct CNV-subregions); OR > 6 |
| 16 | 302 | 759120 | 764070 | 4,950 | loss | 1369 | MIR662, MSLNL | Y | 4 | 31 | 11.92 | Genic (distinct CNV-subregions); OR > 6 |
| 16 | 302 | 759120 | 764070 | 4,950 | loss | 1386 | MIR662, MSLNL | Y | 4 | 31 | 11.92 | Genic (distinct CNV-subregions); OR > 6 |
| 16 | 302 | 759120 | 764070 | 4,950 | loss | 1387 | MIR662, MSLNL | Y | 4 | 31 | 11.92 | Genic (distinct CNV-subregions); OR > 6 |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 16 | 302 | 759120 | 764070 | 4,950 | loss | 1405 | MIR662, MSLNL | Y | 4 | 31 | 11.92 | Genic (distinct CNV-subregions); OR > 6 |
| 16 | 302 | 759120 | 764070 | 4,950 | loss | 1410 | MIR662, MSLNL | Y | 4 | 31 | 11.92 | Genic (distinct CNV-subregions); OR > 6 |
| 16 | 302 | 759120 | 764070 | 4,950 | loss | 1419 | MIR662, MSLNL | Y | 4 | 31 | 11.92 | Genic (distinct CNV-subregions); OR > 6 |
| 16 | 302 | 759120 | 764070 | 4,950 | loss | 1468 | MIR662, MSLNL | Y | 4 | 31 | 11.92 | Genic (distinct CNV-subregions); OR > 6 |
| 16 | 302 | 759120 | 764070 | 4,950 | loss | 1485 | MIR662, MSLNL | Y | 4 | 31 | 11.92 | Genic (distinct CNV-subregions); OR > 6 |
| 16 | 302 | 759120 | 764070 | 4,950 | loss | 1512 | MIR662, MSLNL | Y | 4 | 31 | 11.92 | Genic (distinct CNV-subregions); OR > 6 |
| 16 | 302 | 759120 | 764070 | 4,950 | loss | 1532 | MIR662, MSLNL | Y | 4 | 31 | 11.92 | Genic (distinct CNV-subregions); OR > 6 |
| 16 | 302 | 759120 | 764070 | 4,950 | loss | 1540 | MIR662, MSLNL | Y | 4 | 31 | 11.92 | Genic (distinct CNV-subregions); OR > 6 |
| 16 | 302 | 759120 | 764070 | 4,950 | gain | 1628 | MIR662, MSLNL | Y | 4 | 31 | 11.92 | Genic (distinct CNV-subregions); OR > 6 |
| 16 | 302 | 759120 | 764070 | 4,950 | loss | 1649 | MIR662, MSLNL | Y | 4 | 31 | 11.92 | Genic (distinct CNV-subregions); OR > 6 |
| 16 | 302 | 759120 | 764070 | 4,950 | loss | 1653 | MIR662, MSLNL | Y | 4 | 31 | 11.92 | Genic (distinct CNV-subregions); OR > 6 |
| 16 | 302 | 759120 | 764070 | 4,950 | loss | 1709 | MIR662, MSLNL | Y | 4 | 31 | 11.92 | Genic (distinct CNV-subregions); OR > 6 |
| 16 | 302 | 759120 | 764070 | 4,950 | loss | 1721 | MIR662, MSLNL | Y | 4 | 31 | 11.92 | Genic (distinct CNV-subregions); OR > 6 |
| 16 | 302 | 759120 | 764070 | 4,950 | loss | 1722 | MIR662, MSLNL | Y | 4 | 31 | 11.92 | Genic (distinct CNV-subregions); OR > 6 |
| 16 | 302 | 759120 | 764070 | 4,950 | loss | 1723 | MIR662, MSLNL | Y | 4 | 31 | 11.92 | Genic (distinct CNV-subregions); OR > 6 |
| 16 | 302 | 759120 | 764070 | 4,950 | loss | 1776 | MIR662, MSLNL | Y | 4 | 31 | 11.92 | Genic (distinct CNV-subregions); OR > 6 |
| 16 | 302 | 759120 | 764070 | 4,950 | loss | 1788 | MIR662, MSLNL | Y | 4 | 31 | 11.92 | Genic (distinct CNV-subregions); OR > 6 |
| 16 | 302 | 759120 | 764070 | 4,950 | loss | 1903 | MIR662, MSLNL | Y | 4 | 31 | 11.92 | Genic (distinct CNV-subregions); OR > 6 |
| 16 | 302 | 759120 | 764070 | 4,950 | loss | 1905 | MIR662, MSLNL | Y | 4 | 31 | 11.92 | Genic (distinct CNV-subregions); OR > 6 |
| 16 | 302 | 759120 | 764070 | 4,950 | loss | 1923 | MIR662, MSLNL | Y | 4 | 31 | 11.92 | Genic (distinct CNV-subregions); OR > 6 |
| 16 | 302 | 759120 | 764070 | 4,950 | loss | 1959 | MIR662, MSLNL | Y | 4 | 31 | 11.92 | Genic (distinct CNV-subregions); OR > 6 |
| 16 | 302 | 759120 | 764070 | 4,950 | loss | 2034 | MIR662, MSLNL | Y | 4 | 31 | 11.92 | Genic (distinct CNV-subregions); OR > 6 |
| 16 | 302 | 759120 | 764070 | 4,950 | loss | 2040 | MIR662, MSLNL | Y | 4 | 31 | 11.92 | Genic (distinct CNV-subregions); OR > 6 |
| 16 | 303 | 764071 | 823948 | 59,877 | gain | 1628 | PRR25, MSLNL, RPUSD1, CHTF18, GNG13, | Y | 3 | 1 | 11.92 | Genic (distinct CNV-subregions); OR > 6 |
| 16 | 304 | 3361009 | 3600998 | 239,989 | gain | 1567 | CLUAP1, SLX4, ZNF174, ZNF434, ZNF597, C16orf90, NAT15, NLRC3, MTRNR2L4 | Y | 0 | 1 | 1.47 | MTRNR2L_family |
| 16 | 305 | 4568980 | 4574011 | 5,031 | gain | 1567 | LOC342346 | Y | 1 | 2 | 2.95 | Exon+ve, 5 > ASD > 1, Normals < 2, Sanger-ve |
| 16 | 305 | 4568980 | 4574011 | 5,031 | loss | 1567 | LOC342346 | Y | 1 | 2 | 2.95 | Exon+ve, 5 > ASD > 1, Normals < 2, Sanger-ve |
| 16 | 306 | 18516137 | 18645462 | 129,325 | gain | 1714 | ABCC6P1 | Y | 1 | 3 | 4.44 | Exon+ve, 5 > ASD > 1, Normals < 2, Sanger-ve |
| 16 | 306 | 18516137 | 18645462 | 129,325 | gain | 1811 | ABCC6P1 | Y | 1 | 3 | 4.44 | Exon+ve, 5 > ASD > 1, Normals < 2, Sanger-ve |
| 16 | 306 | 18516137 | 18645462 | 129,325 | gain | 1965 | ABCC6P1 | Y | 1 | 3 | 4.44 | Exon+ve, 5 > ASD > 1, Normals < 2, Sanger-ve |
| 16 | 307 | 29560500 | 29592920 | 32,420 | gain | 1608 | SPN | Y | 1 | 6 | 8.91 | Exon+ve, ASD > 4, Normals < 2, no Sanger filter applied |
| 16 | 307 | 29560500 | 29592920 | 32,420 | loss | 1671 | SPN | Y | 1 | 6 | 8.91 | Exon+ve, ASD > 4, Normals < 2, no Sanger filter applied |
| 16 | 307 | 29560500 | 29592920 | 32,420 | gain | 1700 | SPN | Y | 1 | 6 | 8.91 | Exon+ve, ASD > 4, Normals < 2, no Sanger filter applied |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 16 | 307 | 29560500 | 29592920 | 32,420 | loss | 1823 | SPN | Y | 1 | 6 | 8.91 | Exon+ve, ASD > 4, Normals < 2, no Sanger filter applied |
| 16 | 307 | 29560500 | 29592920 | 32,420 | loss | 1893 | SPN | Y | 1 | 6 | 8.91 | Exon+ve, ASD > 4, Normals < 2, no Sanger filter applied |
| 16 | 307 | 29560500 | 29592920 | 32,420 | gain | 1968 | SPN | Y | 1 | 6 | 8.91 | Exon+ve, ASD > 4, Normals < 2, no Sanger filter applied |
| 16 | 308 | 29598013 | 29619548 | 21,535 | gain | 1608 | QPRT | Y | 1 | 6 | 8.91 | Exon+ve, ASD > 4, Normals < 2, no Sanger filter applied |
| 16 | 308 | 29598013 | 29619548 | 21,535 | loss | 1671 | QPRT | Y | 1 | 6 | 8.91 | Exon+ve, ASD > 4, Normals < 2, no Sanger filter applied |
| 16 | 308 | 29598013 | 29619548 | 21,535 | gain | 1700 | QPRT | Y | 1 | 6 | 8.91 | Exon+ve, ASD > 4, Normals < 2, no Sanger filter applied |
| 16 | 308 | 29598013 | 29619548 | 21,535 | loss | 1823 | QPRT | Y | 1 | 6 | 8.91 | Exon+ve, ASD > 4, Normals < 2, no Sanger filter applied |
| 16 | 308 | 29598013 | 29619548 | 21,535 | loss | 1893 | QPRT | Y | 1 | 6 | 8.91 | Exon+ve, ASD > 4, Normals < 2, no Sanger filter applied |
| 16 | 308 | 29598013 | 29619548 | 21,535 | gain | 1968 | QPRT | Y | 1 | 6 | 8.91 | Exon+ve, ASD > 4, Normals < 2, no Sanger filter applied |
| 16 | 309 | 29619549 | 29955055 | 335,506 | loss | 1671 | MVP, KCTD13, INO80E, ASPHD1, DOC2A, MAZ, ZG16, LOC440356, PRRT2, C16orf92, TAOK2, C16prf53, TMEM219, HIRIP3, SEZ6L2, FAM57B, C16orf54, CDIPT | Y | 1 | 5 | 7.42 | Exon+ve, ASD > 4, Normals < 2, no Sanger filter applied |
| 16 | 309 | 29619549 | 29955055 | 335,506 | gain | 1700 | MVP, KCTD13, INO80E, ASPHD1, DOC2A, MAZ, ZG16, LOC440356, PRRT2, C16orf92, TAOK2, C16prf53, TMEM219, HIRIP3, SEZ6L2, FAM57B, C16orf54, CDIPT | Y | 1 | 5 | 7.42 | Exon+ve, ASD > 4, Normals < 2, no Sanger filter applied |
| 16 | 309 | 29619549 | 29955055 | 335,506 | loss | 1823 | MVP, KCTD13, INO80E, ASPHD1, DOC2A, MAZ, ZG16, LOC440356, PRRT2, C16orf92, TAOK2, C16prf53, TMEM219, HIRIP3, SEZ6L2, FAM57B, C16orf54, CDIPT | Y | 1 | 5 | 7.42 | Exon+ve, ASD > 4, Normals < 2, no Sanger filter applied |
| 16 | 309 | 29619549 | 29955055 | 335,506 | loss | 1893 | MVP, KCTD13, INO80E, ASPHD1, DOC2A, MAZ, ZG16, LOC440356, PRRT2, C16orf92, TAOK2, C16prf53, | Y | 1 | 5 | 7.42 | Exon+ve, ASD > 4, Normals < 2, no Sanger filter applied |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 16 | 309 | 29619549 | 29955055 | 335,506 | gain | 1968 | TMEM219, HIRIP3, SEZ6L2, FAM57B, C16orf54, CDIPT MVP, KCTD13, INO80E, ASPHD1, DOC2A, MAZ, ZG16, LOC440356, PRRT2, C16orf92, TAOK2, C16prf53, TMEM219, HIRIP3, SEZ6L2, FAM57B, C16orf54, CDIPT | Y | 1 | 5 | 7.42 | Exon+ve, ASD > 4, Normals < 2, no Sanger filter applied |
| 16 | 310 | 29959974 | 30027212 | 67,238 | loss | 1671 | ALDOA, GDPD3, PPP4C, TBX6, YPEL3 | Y | 1 | 5 | 7.42 | Exon+ve, ASD > 4, Normals < 2, no Sanger filter applied |
| 16 | 310 | 29959974 | 30027212 | 67,238 | gain | 1671 | ALDOA, GDPD3, PPP4C, TBX6, YPEL3 | Y | 1 | 5 | 7.42 | Exon+ve, ASD > 4, Normals < 2, no Sanger filter applied |
| 16 | 310 | 29959974 | 30027212 | 67,238 | loss | 1671 | ALDOA, GDPD3, PPP4C, TBX6, YPEL3 | Y | 1 | 5 | 7.42 | Exon+ve, ASD > 4, Normals < 2, no Sanger filter applied |
| 16 | 310 | 29959974 | 30027212 | 67,238 | loss | 1671 | ALDOA, GDPD3, PPP4C, TBX6, YPEL3 | Y | 1 | 5 | 7.42 | Exon+ve, ASD > 4, Normals < 2, no Sanger filter applied |
| 16 | 310 | 29959974 | 30027212 | 67,238 | gain | 1968 | ALDOA, GDPD3, PPP4C, TBX6, YPEL3 | Y | 1 | 5 | 7.42 | Exon+ve, ASD > 4, Normals < 2, no Sanger filter applied |
| 16 | 311 | 30099560 | 30104791 | 5,231 | loss | 1671 | CORO1A | Y | 1 | 4 | 5.92 | Exon+ve, 5 > ASD > 1, Normals < 2, Sanger−ve |
| 16 | 311 | 30099560 | 30104791 | 5,231 | gain | 1700 | CORO1A | Y | 1 | 4 | 5.92 | Exon+ve, 5 > ASD > 1, Normals < 2, Sanger−ve |
| 16 | 311 | 30099560 | 30104791 | 5,231 | loss | 1823 | CORO1A | Y | 1 | 4 | 5.92 | Exon+ve, 5 > ASD > 1, Normals < 2, Sanger−ve |
| 16 | 311 | 30099560 | 30104791 | 5,231 | loss | 1893 | CORO1A | Y | 1 | 4 | 5.92 | Exon+ve, 5 > ASD > 1, Normals < 2, Sanger−ve |
| 16 | 312 | 68753210 | 68838384 | 85,174 | gain | 1323 | CLEC18C, LOC729513 | Y | 1 | 7 | 10.41 | Exon+ve, ASD > 4, Normals < 2, no Sanger filter applied |
| 16 | 312 | 68753210 | 68838384 | 85,174 | loss | 1538 | CLEC18C, LOC729513 | Y | 1 | 7 | 10.41 | Exon+ve, ASD > 4, Normals < 2, no Sanger filter applied |
| 16 | 312 | 68753210 | 68838384 | 85,174 | loss | 1742 | CLEC18C, LOC729513 | Y | 1 | 7 | 10.41 | Exon+ve, ASD > 4, Normals < 2, no Sanger filter applied |
| 16 | 312 | 68753210 | 68838384 | 85,174 | loss | 1792 | CLEC18C, LOC729513 | Y | 1 | 7 | 10.41 | Exon+ve, ASD > 4, Normals < 2, no Sanger filter applied |
| 16 | 312 | 68753210 | 68838384 | 85,174 | loss | 1793 | CLEC18C, LOC729513 | Y | 1 | 7 | 10.41 | Exon+ve, ASD > 4, Normals < 2, no Sanger filter applied |
| 16 | 312 | 68753210 | 68838384 | 85,174 | loss | 1875 | CLEC18C, LOC729513 | Y | 1 | 7 | 10.41 | Exon+ve, ASD > 4, Normals < 2, no Sanger filter applied |
| 16 | 312 | 68753210 | 68838384 | 85,174 | loss | 1935 | CLEC18C, LOC729513 | Y | 1 | 7 | 10.41 | Exon+ve, ASD > 4, Normals < 2, no Sanger filter applied |
| 16 | 313 | 68838385 | 68842364 | 3,979 | gain | 1323 | EXOSC6 | Y | 0 | 5 | 7.42 | Exon+ve, ASD > 4, Normals < 2, no Sanger filter applied |
| 16 | 313 | 68838385 | 68842364 | 3,979 | loss | 1538 | EXOSC6 | Y | 0 | 5 | 7.42 | Exon+ve, ASD > 4, Normals < 2, no Sanger filter applied |
| 16 | 313 | 68838385 | 68842364 | 3,979 | loss | 1742 | EXOSC6 | Y | 0 | 5 | 7.42 | Exon+ve, ASD > 4, Normals < 2, no Sanger filter applied |
| 16 | 313 | 68838385 | 68842364 | 3,979 | loss | 1793 | EXOSC6 | Y | 0 | 5 | 7.42 | Exon+ve, ASD > 4, Normals < 2, no Sanger filter applied |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 16 | 313 | 68838385 | 68842364 | 3,979 | loss | 1935 | EXOSC6 | Y | 0 | 5 | 7.42 | Exon+ve, ASD > 4, Normals < 2, no Sanger filter applied |
| 16 | 314 | 70653499 | 70665447 | 11,948 | gain | 1489 | HPR | Y | 1 | 9 | 13.43 | Exon+ve, ASD > 4, Normals < 2, no Sanger filter applied |
| 16 | 314 | 70653499 | 70665447 | 11,948 | gain | 1497 | HPR | Y | 1 | 9 | 13.43 | Exon+ve, ASD > 4, Normals < 2, no Sanger filter applied |
| 16 | 314 | 70653499 | 70665447 | 11,948 | gain | 1723 | HPR | Y | 1 | 9 | 13.43 | Exon+ve, ASD > 4, Normals < 2, no Sanger filter applied |
| 16 | 314 | 70653499 | 70665447 | 11,948 | gain | 1731 | HPR | Y | 1 | 9 | 13.43 | Exon+ve, ASD > 4, Normals < 2, no Sanger filter applied |
| 16 | 314 | 70653499 | 70665447 | 11,948 | gain | 1734 | HPR | Y | 1 | 9 | 13.43 | Exon+ve, ASD > 4, Normals < 2, no Sanger filter applied |
| 16 | 314 | 70653499 | 70665447 | 11,948 | gain | 1737 | HPR | Y | 1 | 9 | 13.43 | Exon+ve, ASD > 4, Normals < 2, no Sanger filter applied |
| 16 | 314 | 70653499 | 70665447 | 11,948 | loss | 1775 | HPR | Y | 1 | 9 | 13.43 | Exon+ve, ASD > 4, Normals < 2, no Sanger filter applied |
| 16 | 314 | 70653499 | 70665447 | 11,948 | gain | 1877 | HPR | Y | 1 | 9 | 13.43 | Exon+ve, ASD > 4, Normals < 2, no Sanger filter applied |
| 16 | 314 | 70653499 | 70665447 | 11,948 | gain | 2034 | HPR | Y | 1 | 9 | 13.43 | Exon+ve, ASD > 4, Normals < 2, no Sanger filter applied |
| 16 | 315 | 72918129 | 72929785 | 11,656 | gain | 1440 | LOC283922 | Y | 0 | 5 | 7.42 | Exon+ve, ASD > 4, Normals < 2, no Sanger filter applied |
| 16 | 315 | 72918129 | 72929785 | 11,656 | gain | 1490 | LOC283922 | Y | 0 | 5 | 7.42 | Exon+ve, ASD > 4, Normals < 2, no Sanger filter applied |
| 16 | 315 | 72918129 | 72929785 | 11,656 | gain | 1449 | LOC283922 | Y | 0 | 5 | 7.42 | Exon+ve, ASD > 4, Normals < 2, no Sanger filter applied |
| 16 | 315 | 72918129 | 72929785 | 11,656 | gain | 1521 | LOC283922 | Y | 0 | 5 | 7.42 | Exon+ve, ASD > 4, Normals < 2, no Sanger filter applied |
| 16 | 315 | 72918129 | 72929785 | 11,656 | gain | 1913 | LOC283922 | Y | 0 | 5 | 7.42 | Exon+ve, ASD > 4, Normals < 2, no Sanger filter applied |
| 16 | 316 | 73038137 | 73040905 | 2,768 | loss | 1263 | GLG1 | Y | 1 | 3 | 4.44 | Exon+ve, 5 > ASD > 1, Normals < 2, Sanger-ve |
| 16 | 316 | 73038137 | 73040905 | 2,768 | loss | 1285 | GLG1 | Y | 1 | 3 | 4.44 | Exon+ve, 5 > ASD > 1, Normals < 2, Sanger-ve |
| 16 | 316 | 73038137 | 73040905 | 2,768 | loss | 1831 | GLG1 | Y | 1 | 3 | 4.44 | Exon+ve, 5 > ASD > 1, Normals < 2, Sanger-ve |
| 16 | 317 | 75093958 | 75097330 | 3,372 | gain | 1423 | CNTNAP4 | N | 1 | 7 | 10.41 | Intron+ve, ASD > 4, Normals < 2, no Sanger filter applied |
| 16 | 317 | 75093958 | 75097330 | 3,372 | gain | 1793 | CNTNAP4 | N | 1 | 7 | 10.41 | Intron+ve, ASD > 4, Normals < 2, no Sanger filter applied |
| 16 | 317 | 75093958 | 75097330 | 3,372 | gain | 1807 | CNTNAP4 | N | 1 | 7 | 10.41 | Intron+ve, ASD > 4, Normals < 2, no Sanger filter applied |
| 16 | 317 | 75093958 | 75097330 | 3,372 | gain | 1823 | CNTNAP4 | N | 1 | 7 | 10.41 | Intron+ve, ASD > 4, Normals < 2, no Sanger filter applied |
| 16 | 317 | 75093958 | 75097330 | 3,372 | gain | 1860 | CNTNAP4 | N | 1 | 7 | 10.41 | Intron+ve, ASD > 4, Normals < 2, no Sanger filter applied |
| 16 | 317 | 75093958 | 75097330 | 3,372 | gain | 1923 | CNTNAP4 | N | 1 | 7 | 10.41 | Intron+ve, ASD > 4, Normals < 2, no Sanger filter applied |
| 16 | 317 | 75093958 | 75097330 | 3,372 | gain | 2035 | CNTNAP4 | N | 1 | 7 | 10.41 | Intron+ve, ASD > 4, Normals < 2, no Sanger filter applied |
| 16 | 318 | 76617253 | 76624877 | 7,624 | gain | 1489 | CLEC3A | Y | 1 | 3 | 4.44 | Exon+ve, 5 > ASD > 1, Normals < 2, Sanger-ve |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 16 | 318 | 76617253 | 76624877 | 7,624 | loss | 1676 | CLEC3A | Y | 1 | 3 | 4.44 | Exon+ve, 5 > ASD > 1, Normals < 2, Sanger-ve |
| 16 | 318 | 76617253 | 76624877 | 7,624 | gain | 1851 | CLEC3A | Y | 1 | 3 | 4.44 | Exon+ve, 5 > ASD > 1, Normals < 2, Sanger-ve |
| 16 | 319 | 76925749 | 76929597 | 3,848 | gain | 1258 | WWOX | N | 0 | 10 | 14.94 | Intron+ve, ASD > 4, Normals < 2, no Sanger filter applied |
| 16 | 319 | 76925749 | 76929597 | 3,848 | gain | 1333 | WWOX | N | 0 | 10 | 14.94 | Intron+ve, ASD > 4, Normals < 2, no Sanger filter applied |
| 16 | 319 | 76925749 | 76929597 | 3,848 | gain | 1354 | WWOX | N | 0 | 10 | 14.94 | Intron+ve, ASD > 4, Normals < 2, no Sanger filter applied |
| 16 | 319 | 76925749 | 76929597 | 3,848 | gain | 1436 | WWOX | N | 0 | 10 | 14.94 | Intron+ve, ASD > 4, Normals < 2, no Sanger filter applied |
| 16 | 319 | 76925749 | 76929597 | 3,848 | gain | 1454 | WWOX | N | 0 | 10 | 14.94 | Intron+ve, ASD > 4, Normals < 2, no Sanger filter applied |
| 16 | 319 | 76925749 | 76929597 | 3,848 | gain | 1605 | WWOX | N | 0 | 10 | 14.94 | Intron+ve, ASD > 4, Normals < 2, no Sanger filter applied |
| 16 | 319 | 76925749 | 76929597 | 3,848 | gain | 1683 | WWOX | N | 0 | 10 | 14.94 | Intron+ve, ASD > 4, Normals < 2, no Sanger filter applied |
| 16 | 319 | 76925749 | 76929597 | 3,848 | gain | 1851 | WWOX | N | 0 | 10 | 14.94 | Intron+ve, ASD > 4, Normals < 2, no Sanger filter applied |
| 16 | 319 | 76925749 | 76929597 | 3,848 | gain | 1925 | WWOX | N | 0 | 10 | 14.94 | Intron+ve, ASD > 4, Normals < 2, no Sanger filter applied |
| 16 | 319 | 76925749 | 76929597 | 3,848 | gain | 1969 | WWOX | N | 0 | 10 | 14.94 | Intron+ve, ASD > 4, Normals < 2, no Sanger filter applied |
| 17 | 320 | 4617676 | 4629628 | 11,952 | loss | 1692 | TM4SF5 | Y | 1 | 2 | 2.95 | Exon+ve, 5 > ASD > 1, Normals < 2, Sanger-ve |
| 17 | 320 | 4617676 | 4629628 | 11,952 | loss | 1924 | TM4SF5 | Y | 1 | 2 | 2.95 | Exon+ve, 5 > ASD > 1, Normals < 2, Sanger-ve |
| 17 | 321 | 12435897 | 12441508 | 5,611 | loss | 1416 | FLJ34690 | N | 0 | 7 | 10.41 | Intron+ve, ASD > 4, Normals < 2, no Sanger filter applied |
| 17 | 321 | 12435897 | 12441508 | 5,611 | gain | 1520 | FLJ34690 | N | 0 | 7 | 10.41 | Intron+ve, ASD > 4, Normals < 2, no Sanger filter applied |
| 17 | 321 | 12435897 | 12441508 | 5,611 | loss | 1676 | FLJ34690 | N | 0 | 7 | 10.41 | Intron+ve, ASD > 4, Normals < 2, no Sanger filter applied |
| 17 | 321 | 12435897 | 12441508 | 5,611 | loss | 1678 | FLJ34690 | N | 0 | 7 | 10.41 | Intron+ve, ASD > 4, Normals < 2, no Sanger filter applied |
| 17 | 321 | 12435897 | 12441508 | 5,611 | loss | 1852 | FLJ34690 | N | 0 | 7 | 10.41 | Intron+ve, ASD > 4, Normals < 2, no Sanger filter applied |
| 17 | 321 | 12435897 | 12441508 | 5,611 | loss | 1878 | FLJ34690 | N | 0 | 7 | 10.41 | Intron+ve, ASD > 4, Normals < 2, no Sanger filter applied |
| 17 | 321 | 12435897 | 12441508 | 5,611 | loss | 2028 | FLJ34690 | N | 0 | 7 | 10.41 | Intron+ve, ASD > 4, Normals < 2, no Sanger filter applied |
| 17 | 322 | 21845327 | 21956831 | 111,504 | gain | 1454 | MTRNR2L1 | Y | 1 | 4 | 5.92 | MTRNR2L_family |
| 17 | 322 | 21845327 | 21956831 | 111,504 | gain | 1584 | MTRNR2L1 | Y | 1 | 4 | 5.92 | MTRNR2L_family |
| 17 | 322 | 21845327 | 21956831 | 111,504 | loss | 1743 | MTRNR2L1 | Y | 1 | 4 | 5.92 | MTRNR2L_family |
| 17 | 322 | 21845327 | 21956831 | 111,504 | gain | 1837 | MTRNR2L1 | Y | 1 | 4 | 5.92 | MTRNR2L_family |
| 17 | 323 | 32832643 | 32833765 | 1,122 | gain | 1252 | ACACA | N | 0 | 9 | 13.43 | Intron+ve, ASD > 4, Normals < 2, no Sanger filter applied |
| 17 | 323 | 32832643 | 32833765 | 1,122 | gain | 1285 | ACACA | N | 0 | 9 | 13.43 | Intron+ve, ASD > 4, Normals < 2, no Sanger filter applied |
| 17 | 323 | 32832643 | 32833765 | 1,122 | gain | 1372 | ACACA | N | 0 | 9 | 13.43 | Intron+ve, ASD > 4, Normals < 2, no Sanger filter applied |
| 17 | 323 | 32832643 | 32833765 | 1,122 | gain | 1407 | ACACA | N | 0 | 9 | 13.43 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 17 | 323 | 32832643 | 32833765 | 1,122 | gain | 1434 | ACACA | N | 0 | 9 | 13.43 | Intron+ve, ASD > 4, Normals < 2, no Sanger filter applied |
| 17 | 323 | 32832643 | 32833765 | 1,122 | gain | 1573 | ACACA | N | 0 | 9 | 13.43 | Intron+ve, ASD > 4, Normals < 2, no Sanger filter applied |
| 17 | 323 | 32832643 | 32833765 | 1,122 | gain | 1617 | ACACA | N | 0 | 9 | 13.43 | Intron+ve, ASD > 4, Normals < 2, no Sanger filter applied |
| 17 | 323 | 32832643 | 32833765 | 1,122 | gain | 1825 | ACACA | N | 0 | 9 | 13.43 | Intron+ve, ASD > 4, Normals < 2, no Sanger filter applied |
| 17 | 323 | 32832643 | 32833765 | 1,122 | gain | 2042 | ACACA | N | 0 | 9 | 13.43 | Intron+ve, ASD > 4, Normals < 2, no Sanger filter applied |
| 17 | 324 | 40209354 | 40213056 | 3,702 | loss | 1836 | ADAM11 | Y | 1 | 2 | 2.95 | Exon+ve, 5 > ASD > 1, Normals < 2, Sanger-ve |
| 17 | 324 | 40209354 | 40213056 | 3,702 | loss | 1955 | ADAM11 | Y | 1 | 2 | 2.95 | Exon+ve, 5 > ASD > 1, Normals < 2, Sanger-ve |
| 17 | 325 | 41508943 | 41512317 | 3,374 | loss | 1319 | KIAA1267 | N | 0 | 6 | 8.91 | Intron+ve, ASD > 4, Normals < 2, no Sanger filter applied |
| 17 | 325 | 41508943 | 41512317 | 3,374 | loss | 1320 | KIAA1267 | N | 0 | 6 | 8.91 | Intron+ve, ASD > 4, Normals < 2, no Sanger filter applied |
| 17 | 325 | 41508943 | 41512317 | 3,374 | loss | 1542 | KIAA1267 | N | 0 | 6 | 8.91 | Intron+ve, ASD > 4, Normals < 2, no Sanger filter applied |
| 17 | 325 | 41508943 | 41512317 | 3,374 | loss | 1587 | KIAA1267 | N | 0 | 6 | 8.91 | Intron+ve, ASD > 4, Normals < 2, no Sanger filter applied |
| 17 | 325 | 41508943 | 41512317 | 3,374 | loss | 1656 | KIAA1267 | N | 0 | 6 | 8.91 | Intron+ve, ASD > 4, Normals < 2, no Sanger filter applied |
| 17 | 325 | 41508943 | 41512317 | 3,374 | loss | 1861 | KIAA1267 | N | 0 | 6 | 8.91 | Intron+ve, ASD > 4, Normals < 2, no Sanger filter applied |
| 17 | 326 | 41512318 | 41514480 | 2,162 | loss | 1319 | KIAA1267 | N | 0 | 15 | 22.58 | Intron+ve, ASD > 4, Normals < 2, no Sanger filter applied |
| 17 | 326 | 41512318 | 41514480 | 2,162 | loss | 1320 | KIAA1267 | N | 0 | 15 | 22.58 | Intron+ve, ASD > 4, Normals < 2, no Sanger filter applied |
| 17 | 326 | 41512318 | 41514480 | 2,162 | loss | 1530 | KIAA1267 | N | 0 | 15 | 22.58 | Intron+ve, ASD > 4, Normals < 2, no Sanger filter applied |
| 17 | 326 | 41512318 | 41514480 | 2,162 | loss | 1533 | KIAA1267 | N | 0 | 15 | 22.58 | Intron+ve, ASD > 4, Normals < 2, no Sanger filter applied |
| 17 | 326 | 41512318 | 41514480 | 2,162 | loss | 1535 | KIAA1267 | N | 0 | 15 | 22.58 | Intron+ve, ASD > 4, Normals < 2, no Sanger filter applied |
| 17 | 326 | 41512318 | 41514480 | 2,162 | loss | 1536 | KIAA1267 | N | 0 | 15 | 22.58 | Intron+ve, ASD > 4, Normals < 2, no Sanger filter applied |
| 17 | 326 | 41512318 | 41514480 | 2,162 | loss | 1537 | KIAA1267 | N | 0 | 15 | 22.58 | Intron+ve, ASD > 4, Normals < 2, no Sanger filter applied |
| 17 | 326 | 41512318 | 41514480 | 2,162 | loss | 1539 | KIAA1267 | N | 0 | 15 | 22.58 | Intron+ve, ASD > 4, Normals < 2, no Sanger filter applied |
| 17 | 326 | 41512318 | 41514480 | 2,162 | loss | 1542 | KIAA1267 | N | 0 | 15 | 22.58 | Intron+ve, ASD > 4, Normals < 2, no Sanger filter applied |
| 17 | 326 | 41512318 | 41514480 | 2,162 | loss | 1586 | KIAA1267 | N | 0 | 15 | 22.58 | Intron+ve, ASD > 4, Normals < 2, no Sanger filter applied |
| 17 | 326 | 41512318 | 41514480 | 2,162 | loss | 1587 | KIAA1267 | N | 0 | 15 | 22.58 | Intron+ve, ASD > 4, Normals < 2, no Sanger filter applied |
| 17 | 326 | 41512318 | 41514480 | 2,162 | loss | 1656 | KIAA1267 | N | 0 | 15 | 22.58 | Intron+ve, ASD > 4, Normals < 2, no Sanger filter applied |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 17 | 326 | 41512318 | 41514480 | 2,162 | loss | 1662 | KIAA1267 | N | 0 | 15 | 22.58 | Intron+ve, ASD > 4, Normals < 2, no Sanger filter applied |
| 17 | 326 | 41512318 | 41514480 | 2,162 | loss | 1684 | KIAA1267 | N | 0 | 15 | 22.58 | Intron+ve, ASD > 4, Normals < 2, no Sanger filter applied |
| 17 | 326 | 41512318 | 41514480 | 2,162 | loss | 1861 | KIAA1267 | N | 0 | 15 | 22.58 | Intron+ve, ASD > 4, Normals < 2, no Sanger filter applied |
| 17 | 327 | 41518222 | 41519701 | 1,479 | loss | 1319 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1320 | KIAA1267 | N | 1 | 26 | 39.79 | Intron+ve, ASD > 4, Normals < 2, no Sanger filter applied |
| 17 | 327 | 41518222 | 41519701 | 1,479 | gain | 1394 | KIAA1267 | N | 1 | 26 | 39.79 | Intron+ve, ASD > 4, Normals < 2, no Sanger filter applied |
| 17 | 327 | 41518222 | 41519701 | 1,479 | gain | 1465 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1530 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1533 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1535 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1536 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1537 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1539 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1542 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1586 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1587 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1655 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1656 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1662 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1675 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1684 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1734 | KIAA1267 | N | 1 | 26 | 39.79 | Intron+ve, ASD > 4, Normals < 2, no Sanger filter applied |
| 17 | 327 | 41518222 | 41519701 | 1,479 | gain | 1840 | KIAA1267 | N | 1 | 26 | 39.79 | Intron+ve, ASD > 4, Normals < 2, no Sanger filter applied |
| 17 | 327 | 41518222 | 41519701 | 1,479 | gain | 1844 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1861 | KIAA1267 | N | 1 | 26 | 39.79 | Intron+ve, ASD > 4, Normals < 2, no Sanger filter applied |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 17 | 327 | 41518222 | 41519701 | 1,479 | gain | 1869 | KIAA1267 | N | 1 | 26 | 39.79 | Intron+ve, ASD > 4, Normals < 2, no Sanger filter applied |
| 17 | 327 | 41518222 | 41519701 | 1,479 | loss | 1887 | KIAA1267 | N | 1 | 26 | 39.79 | Intron+ve, ASD > 4, Normals < 2, no Sanger filter applied |
| 17 | 327 | 41518222 | 41519701 | 1,479 | gain | 1907 | KIAA1267 | N | 1 | 26 | 39.79 | Intron+ve, ASD > 4, Normals < 2, no Sanger filter applied |
| 17 | 327 | 41518222 | 41519701 | 1,479 | gain | 1914 | KIAA1267 | N | 1 | 26 | 39.79 | Intron+ve, ASD > 4, Normals < 2, no Sanger filter applied |
| 17 | 328 | 42142364 | 42143048 | 684 | loss | 1250 | NSF | N | 0 | 10 | 14.94 | Intron+ve, ASD > 4, Normals < 2, no Sanger filter applied |
| 17 | 328 | 42142364 | 42143048 | 684 | loss | 1266 | NSF | N | 0 | 10 | 14.94 | Intron+ve, ASD > 4, Normals < 2, no Sanger filter applied |
| 17 | 328 | 42142364 | 42143048 | 684 | loss | 1436 | NSF | N | 0 | 10 | 14.94 | Intron+ve, ASD > 4, Normals < 2, no Sanger filter applied |
| 17 | 328 | 42142364 | 42143048 | 684 | loss | 1536 | NSF | N | 0 | 10 | 14.94 | Intron+ve, ASD > 4, Normals < 2, no Sanger filter applied |
| 17 | 328 | 42142364 | 42143048 | 684 | gain | 1671 | NSF | N | 0 | 10 | 14.94 | Intron+ve, ASD > 4, Normals < 2, no Sanger filter applied |
| 17 | 328 | 42142364 | 42143048 | 684 | gain | 1751 | NSF | N | 0 | 10 | 14.94 | Intron+ve, ASD > 4, Normals < 2, no Sanger filter applied |
| 17 | 328 | 42142364 | 42143048 | 684 | gain | 1800 | NSF | N | 0 | 10 | 14.94 | Intron+ve, ASD > 4, Normals < 2, no Sanger filter applied |
| 17 | 328 | 42142364 | 42143048 | 684 | gain | 1991 | NSF | N | 0 | 10 | 14.94 | Intron+ve, ASD > 4, Normals < 2, no Sanger filter applied |
| 17 | 328 | 42142364 | 42143048 | 684 | gain | 2032 | NSF | N | 0 | 10 | 14.94 | Intron+ve, ASD > 4, Normals < 2, no Sanger filter applied |
| 17 | 328 | 42142364 | 42143048 | 684 | gain | 2036 | NSF | N | 0 | 10 | 14.94 | Intron+ve, ASD > 4, Normals < 2, no Sanger filter applied |
| 17 | 329 | 57331106 | 57336509 | 5,403 | loss | 1439 | INTS2 | N | 0 | 5 | 7.42 | Intron+ve, ASD > 4, Normals < 2, no Sanger filter applied |
| 17 | 329 | 57331106 | 57336509 | 5,403 | loss | 1601 | INTS2 | N | 0 | 5 | 7.42 | Intron+ve, ASD > 4, Normals < 2, no Sanger filter applied |
| 17 | 329 | 57331106 | 57336509 | 5,403 | loss | 1641 | INTS2 | N | 0 | 5 | 7.42 | Intron+ve, ASD > 4, Normals < 2, no Sanger filter applied |
| 17 | 329 | 57331106 | 57336509 | 5,403 | loss | 1784 | INTS2 | N | 0 | 5 | 7.42 | Intron+ve, ASD > 4, Normals < 2, no Sanger filter applied |
| 17 | 329 | 57331106 | 57336509 | 5,403 | gain | 1875 | INTS2 | N | 0 | 5 | 7.42 | Intron+ve, ASD > 4, Normals < 2, no Sanger filter applied |
| 17 | 330 | 68331630 | 68336699 | 5,069 | loss | 1283 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1296 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1306 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1309 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1344 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1370 | SLC39A11 | N | 1 | 17 | 25.67 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 17 | 330 | 68331630 | 68336699 | 5,069 | loss | 1394 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1396 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1410 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1708 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1776 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1831 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1833 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1843 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1898 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1921 | SLC39A11 | N | 1 | 17 | 25.67 | Intron+ve, ASD > 4, Normals < 2, no Sanger filter applied |
| 17 | 330 | 68331630 | 68336699 | 5,069 | loss | 1928 | SLC39A11 | N | 1 | 17 | 25.67 | Intron+ve, ASD > 4, Normals < 2, no Sanger filter applied |
| 17 | 331 | 76213226 | 76214810 | 1,584 | gain | 1831 | RPTOR | Y | 1 | 3 | 4.44 | Exon+ve, 5 > ASD > 1, Normals < 2, Sanger−ve |
| 17 | 331 | 76213226 | 76214810 | 1,584 | gain | 1852 | RPTOR | Y | 1 | 3 | 4.44 | Exon+ve, 5 > ASD > 1, Normals < 2, Sanger−ve |
| 17 | 331 | 76213226 | 76214810 | 1,584 | gain | 1929 | RPTOR | Y | 1 | 3 | 4.44 | Exon+ve, 5 > ASD > 1, Normals < 2, Sanger−ve |
| 18 | 332 | 503208 | 505456 | 2,248 | loss | 1284 | | N | 0 | 34 | 52.68 | high OR intergenic (OR > 30) |
| 18 | 332 | 503208 | 505456 | 2,248 | loss | 1389 | | N | 0 | 34 | 52.68 | high OR intergenic (OR > 30) |
| 18 | 332 | 503208 | 505456 | 2,248 | loss | 1413 | | N | 0 | 34 | 52.68 | high OR intergenic (OR > 30) |
| 18 | 332 | 503208 | 505456 | 2,248 | loss | 1415 | | N | 0 | 34 | 52.68 | high OR intergenic (OR > 30) |
| 18 | 332 | 503208 | 505456 | 2,248 | loss | 1439 | | N | 0 | 34 | 52.68 | high OR intergenic (OR > 30) |
| 18 | 332 | 503208 | 505456 | 2,248 | loss | 1452 | | N | 0 | 34 | 52.68 | high OR intergenic (OR > 30) |
| 18 | 332 | 503208 | 505456 | 2,248 | loss | 1464 | | N | 0 | 34 | 52.68 | high OR intergenic (OR > 30) |
| 18 | 332 | 503208 | 505456 | 2,248 | loss | 1472 | | N | 0 | 34 | 52.68 | high OR intergenic (OR > 30) |
| 18 | 332 | 503208 | 505456 | 2,248 | loss | 1474 | | N | 0 | 34 | 52.68 | high OR intergenic (OR > 30) |
| 18 | 332 | 503208 | 505456 | 2,248 | loss | 1472 | | N | 0 | 34 | 52.68 | high OR intergenic (OR > 30) |
| 18 | 332 | 503208 | 505456 | 2,248 | loss | 1495 | | N | 0 | 34 | 52.68 | high OR intergenic (OR > 30) |
| 18 | 332 | 503208 | 505456 | 2,248 | loss | 1504 | | N | 0 | 34 | 52.68 | high OR intergenic (OR > 30) |
| 18 | 332 | 503208 | 505456 | 2,248 | gain | 1534 | | N | 0 | 34 | 52.68 | high OR intergenic (OR > 30) |
| 18 | 332 | 503208 | 505456 | 2,248 | loss | 1545 | | N | 0 | 34 | 52.68 | high OR intergenic (OR > 30) |
| 18 | 332 | 503208 | 505456 | 2,248 | loss | 1567 | | N | 0 | 34 | 52.68 | high OR intergenic (OR > 30) |
| 18 | 332 | 503208 | 505456 | 2,248 | loss | 1568 | | N | 0 | 34 | 52.68 | high OR intergenic (OR > 30) |
| 18 | 332 | 503208 | 505456 | 2,248 | loss | 1572 | | N | 0 | 34 | 52.68 | high OR intergenic (OR > 30) |
| 18 | 332 | 503208 | 505456 | 2,248 | loss | 1584 | | N | 0 | 34 | 52.68 | high OR intergenic (OR > 30) |
| 18 | 332 | 503208 | 505456 | 2,248 | gain | 1662 | | N | 0 | 34 | 52.68 | high OR intergenic (OR > 30) |
| 18 | 332 | 503208 | 505456 | 2,248 | loss | 1672 | | N | 0 | 34 | 52.68 | high OR intergenic (OR > 30) |
| 18 | 332 | 503208 | 505456 | 2,248 | loss | 1699 | | N | 0 | 34 | 52.68 | high OR intergenic (OR > 30) |
| 18 | 332 | 503208 | 505456 | 2,248 | loss | 1703 | | N | 0 | 34 | 52.68 | high OR intergenic (OR > 30) |
| 18 | 332 | 503208 | 505456 | 2,248 | loss | 1730 | | N | 0 | 34 | 52.68 | high OR intergenic (OR > 30) |
| 18 | 332 | 503208 | 505456 | 2,248 | gain | 1777 | | N | 0 | 34 | 52.68 | high OR intergenic (OR > 30) |
| 18 | 332 | 503208 | 505456 | 2,248 | loss | 1802 | | N | 0 | 34 | 52.68 | high OR intergenic (OR > 30) |
| 18 | 332 | 503208 | 505456 | 2,248 | loss | 1809 | | N | 0 | 34 | 52.68 | high OR intergenic (OR > 30) |
| 18 | 332 | 503208 | 505456 | 2,248 | loss | 1830 | | N | 0 | 34 | 52.68 | high OR intergenic (OR > 30) |
| 18 | 332 | 503208 | 505456 | 2,248 | loss | 1870 | | N | 0 | 34 | 52.68 | high OR intergenic (OR > 30) |
| 18 | 332 | 503208 | 505456 | 2,248 | gain | 1871 | | N | 0 | 34 | 52.68 | high OR intergenic (OR > 30) |
| 18 | 332 | 503208 | 505456 | 2,248 | loss | 1875 | | N | 0 | 34 | 52.68 | high OR intergenic (OR > 30) |
| 18 | 332 | 503208 | 505456 | 2,248 | loss | 1968 | | N | 0 | 34 | 52.68 | high OR intergenic (OR > 30) |
| 18 | 332 | 503208 | 505456 | 2,248 | loss | 1999 | | N | 0 | 34 | 52.68 | high OR intergenic (OR > 30) |
| 18 | 332 | 503208 | 505456 | 2,248 | loss | 2031 | | N | 0 | 34 | 52.68 | high OR intergenic (OR > 30) |
| 18 | 332 | 503208 | 505456 | 2,248 | loss | 2044 | | N | 0 | 34 | 52.68 | high OR intergenic (OR > 30) |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 18 | 333 | 17513277 | 17514596 | 1,319 | gain | 1250 | ABHD3 | N | 0 | 6 | 8.91 | Intron+ve, ASD > 4, Normals < 2, no Sanger filter applied |
| 18 | 333 | 17513277 | 17514596 | 1,319 | loss | 1426 | ABHD3 | N | 0 | 6 | 8.91 | Intron+ve, ASD > 4, Normals < 2, no Sanger filter applied |
| 18 | 333 | 17513277 | 17514596 | 1,319 | loss | 1442 | ABHD3 | N | 0 | 6 | 8.91 | Intron+ve, ASD > 4, Normals < 2, no Sanger filter applied |
| 18 | 333 | 17513277 | 17514596 | 1,319 | gain | 1611 | ABHD3 | N | 0 | 6 | 8.91 | Intron+ve, ASD > 4, Normals < 2, no Sanger filter applied |
| 18 | 333 | 17513277 | 17514596 | 1,319 | loss | 1670 | ABHD3 | N | 0 | 6 | 8.91 | Intron+ve, ASD > 4, Normals < 2, no Sanger filter applied |
| 18 | 333 | 17513277 | 17514596 | 1,319 | gain | 2045 | ABHD3 | N | 0 | 6 | 8.91 | Intron+ve, ASD > 4, Normals < 2, no Sanger filter applied |
| 18 | 334 | 48698719 | 48702421 | 3,702 | gain | 1227 | DCC | N | 0 | 11 | 16.46 | Intron+ve, ASD > 4, Normals < 2, no Sanger filter applied |
| 18 | 334 | 48698719 | 48702421 | 3,702 | gain | 1236 | DCC | N | 0 | 11 | 16.46 | Intron+ve, ASD > 4, Normals < 2, no Sanger filter applied |
| 18 | 334 | 48698719 | 48702421 | 3,702 | gain | 1354 | DCC | N | 0 | 11 | 16.46 | Intron+ve, ASD > 4, Normals < 2, no Sanger filter applied |
| 18 | 334 | 48698719 | 48702421 | 3,702 | gain | 1459 | DCC | N | 0 | 11 | 16.46 | Intron+ve, ASD > 4, Normals < 2, no Sanger filter applied |
| 18 | 334 | 48698719 | 48702421 | 3,702 | gain | 1464 | DCC | N | 0 | 11 | 16.46 | Intron+ve, ASD > 4, Normals < 2, no Sanger filter applied |
| 18 | 334 | 48698719 | 48702421 | 3,702 | gain | 1572 | DCC | N | 0 | 11 | 16.46 | Intron+ve, ASD > 4, Normals < 2, no Sanger filter applied |
| 18 | 334 | 48698719 | 48702421 | 3,702 | gain | 1617 | DCC | N | 0 | 11 | 16.46 | Intron+ve, ASD > 4, Normals < 2, no Sanger filter applied |
| 18 | 334 | 48698719 | 48702421 | 3,702 | gain | 1792 | DCC | N | 0 | 11 | 16.46 | Intron+ve, ASD > 4, Normals < 2, no Sanger filter applied |
| 18 | 334 | 48698719 | 48702421 | 3,702 | gain | 1818 | DCC | N | 0 | 11 | 16.46 | Intron+ve, ASD > 4, Normals < 2, no Sanger filter applied |
| 18 | 334 | 48698719 | 48702421 | 3,702 | gain | 1857 | DCC | N | 0 | 11 | 16.46 | Intron+ve, ASD > 4, Normals < 2, no Sanger filter applied |
| 18 | 334 | 48698719 | 48702421 | 3,702 | gain | 2026 | DCC | N | 0 | 11 | 16.46 | Intron+ve, ASD > 4, Normals < 2, no Sanger filter applied |
| 18 | 335 | 48708982 | 48714801 | 5,819 | gain | 1227 | DCC | N | 1 | 17 | 25.67 | Intron+ve, ASD > 4, Normals < 2, no Sanger filter applied |
| 18 | 335 | 48708982 | 48714801 | 5,819 | gain | 1236 | DCC | N | 1 | 17 | 25.67 | Intron+ve, ASD > 4, Normals < 2, no Sanger filter applied |
| 18 | 335 | 48708982 | 48714801 | 5,819 | gain | 1354 | DCC | N | 1 | 17 | 25.67 | Intron+ve, ASD > 4, Normals < 2, no Sanger filter applied |
| 18 | 335 | 48708982 | 48714801 | 5,819 | gain | 1415 | DCC | N | 1 | 17 | 25.67 | Intron+ve, ASD > 4, Normals < 2, no Sanger filter applied |
| 18 | 335 | 48708982 | 48714801 | 5,819 | gain | 1459 | DCC | N | 1 | 17 | 25.67 | Intron+ve, ASD > 4, Normals < 2, no Sanger filter applied |
| 18 | 335 | 48708982 | 48714801 | 5,819 | gain | 1464 | DCC | N | 1 | 17 | 25.67 | Intron+ve, ASD > 4, Normals < 2, no Sanger filter applied |
| 18 | 335 | 48708982 | 48714801 | 5,819 | gain | 1572 | DCC | N | 1 | 17 | 25.67 | Intron+ve, ASD > 4, Normals < 2, no Sanger filter applied |
| 18 | 335 | 48708982 | 48714801 | 5,819 | gain | 1617 | DCC | N | 1 | 17 | 25.67 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 18 | 335 | 48708982 | 48714801 | 5,819 | gain | 1672 | DCC | N | 1 | 17 | 25.67 | Intron+ve, ASD > 4, Normals < 2, no Sanger filter applied |
| 18 | 335 | 48708982 | 48714801 | 5,819 | gain | 1697 | DCC | N | 1 | 17 | 25.67 | Intron+ve, ASD > 4, Normals < 2, no Sanger filter applied |
| 18 | 335 | 48708982 | 48714801 | 5,819 | gain | 1728 | DCC | N | 1 | 17 | 25.67 | Intron+ve, ASD > 4, Normals < 2, no Sanger filter applied |
| 18 | 335 | 48708982 | 48714801 | 5,819 | gain | 1740 | DCC | N | 1 | 17 | 25.67 | Intron+ve, ASD > 4, Normals < 2, no Sanger filter applied |
| 18 | 335 | 48708982 | 48714801 | 5,819 | gain | 1776 | DCC | N | 1 | 17 | 25.67 | Intron+ve, ASD > 4, Normals < 2, no Sanger filter applied |
| 18 | 335 | 48708982 | 48714801 | 5,819 | gain | 1792 | DCC | N | 1 | 17 | 25.67 | Intron+ve, ASD > 4, Normals < 2, no Sanger filter applied |
| 18 | 335 | 48708982 | 48714801 | 5,819 | gain | 1818 | DCC | N | 1 | 17 | 25.67 | Intron+ve, ASD > 4, Normals < 2, no Sanger filter applied |
| 18 | 335 | 48708982 | 48714801 | 5,819 | gain | 1857 | DCC | N | 1 | 17 | 25.67 | Intron+ve, ASD > 4, Normals < 2, no Sanger filter applied |
| 18 | 335 | 48708982 | 48714801 | 5,819 | gain | 2026 | DCC | N | 1 | 17 | 25.67 | Intron+ve, ASD > 4, Normals < 2, no Sanger filter applied |
| 18 | 336 | 48714802 | 48716663 | 1,861 | gain | 1227 | DCC | N | 1 | 18 | 27.22 | Intron+ve, ASD > 4, Normals < 2, no Sanger filter applied |
| 18 | 336 | 48714802 | 48716663 | 1,861 | gain | 1236 | DCC | N | 1 | 18 | 27.22 | Intron+ve, ASD > 4, Normals < 2, no Sanger filter applied |
| 18 | 336 | 48714802 | 48716663 | 1,861 | gain | 1354 | DCC | N | 1 | 18 | 27.22 | Intron+ve, ASD > 4, Normals < 2, no Sanger filter applied |
| 18 | 336 | 48714802 | 48716663 | 1,861 | gain | 1405 | DCC | N | 1 | 18 | 27.22 | Intron+ve, ASD > 4, Normals < 2, no Sanger filter applied |
| 18 | 336 | 48714802 | 48716663 | 1,861 | gain | 1415 | DCC | N | 1 | 18 | 27.22 | Intron+ve, ASD > 4, Normals < 2, no Sanger filter applied |
| 18 | 336 | 48714802 | 48716663 | 1,861 | gain | 1459 | DCC | N | 1 | 18 | 27.22 | Intron+ve, ASD > 4, Normals < 2, no Sanger filter applied |
| 18 | 336 | 48714802 | 48716663 | 1,861 | gain | 1464 | DCC | N | 1 | 18 | 27.22 | Intron+ve, ASD > 4, Normals < 2, no Sanger filter applied |
| 18 | 336 | 48714802 | 48716663 | 1,861 | gain | 1572 | DCC | N | 1 | 18 | 27.22 | Intron+ve, ASD > 4, Normals < 2, no Sanger filter applied |
| 18 | 336 | 48714802 | 48716663 | 1,861 | gain | 1617 | DCC | N | 1 | 18 | 27.22 | Intron+ve, ASD > 4, Normals < 2, no Sanger filter applied |
| 18 | 336 | 48714802 | 48716663 | 1,861 | gain | 1672 | DCC | N | 1 | 18 | 27.22 | Intron+ve, ASD > 4, Normals < 2, no Sanger filter applied |
| 18 | 336 | 48714802 | 48716663 | 1,861 | gain | 1697 | DCC | N | 1 | 18 | 27.22 | Intron+ve, ASD > 4, Normals < 2, no Sanger filter applied |
| 18 | 336 | 48714802 | 48716663 | 1,861 | gain | 1728 | DCC | N | 1 | 18 | 27.22 | Intron+ve, ASD > 4, Normals < 2, no Sanger filter applied |
| 18 | 336 | 48714802 | 48716663 | 1,861 | gain | 1740 | DCC | N | 1 | 18 | 27.22 | Intron+ve, ASD > 4, Normals < 2, no Sanger filter applied |
| 18 | 336 | 48714802 | 48716663 | 1,861 | gain | 1776 | DCC | N | 1 | 18 | 27.22 | Intron+ve, ASD > 4, Normals < 2, no Sanger filter applied |
| 18 | 336 | 48714802 | 48716663 | 1,861 | gain | 1792 | DCC | N | 1 | 18 | 27.22 | Intron+ve, ASD > 4, Normals < 2, no Sanger filter applied |
| 18 | 336 | 48714802 | 48716663 | 1,861 | gain | 1818 | DCC | N | 1 | 18 | 27.22 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 18 | 336 | 48714802 | 48716663 | 1,861 | gain | 1857 | DCC | N | 1 | 18 | 27.22 | Intron+ve, ASD > 4, Normals < 2, no Sanger filter applied |
| 18 | 336 | 48714802 | 48716663 | 1,861 | gain | 2026 | DCC | N | 1 | 18 | 27.22 | Intron+ve, ASD > 4, Normals < 2, no Sanger filter applied |
| 18 | 337 | 65367912 | 65369843 | 1,931 | loss | 1296 | DOK6 | N | 0 | 7 | 10.41 | Intron+ve, ASD > 4, Normals < 2, no Sanger filter applied |
| 18 | 337 | 65367912 | 65369843 | 1,931 | loss | 1307 | DOK6 | N | 0 | 7 | 10.41 | Intron+ve, ASD > 4, Normals < 2, no Sanger filter applied |
| 18 | 337 | 65367912 | 65369843 | 1,931 | loss | 1370 | DOK6 | N | 0 | 7 | 10.41 | Intron+ve, ASD > 4, Normals < 2, no Sanger filter applied |
| 18 | 337 | 65367912 | 65369843 | 1,931 | loss | 1664 | DOK6 | N | 0 | 7 | 10.41 | Intron+ve, ASD > 4, Normals < 2, no Sanger filter applied |
| 18 | 337 | 65367912 | 65369843 | 1,931 | loss | 1852 | DOK6 | N | 0 | 7 | 10.41 | Intron+ve, ASD > 4, Normals < 2, no Sanger filter applied |
| 18 | 337 | 65367912 | 65369843 | 1,931 | loss | 1905 | DOK6 | N | 0 | 7 | 10.41 | Intron+ve, ASD > 4, Normals < 2, no Sanger filter applied |
| 18 | 337 | 65367912 | 65369843 | 1,931 | loss | 1935 | DOK6 | N | 0 | 7 | 10.41 | Intron+ve, ASD > 4, Normals < 2, no Sanger filter applied |
| 18 | 338 | 65911512 | 65915538 | 4,026 | loss | 1276 | RTTN | N | 0 | 3 | 8.91 | Genic (distinct CNV-subregions); OR > 6 |
| 18 | 338 | 65911512 | 65915538 | 4,026 | loss | 1493 | RTTN | N | 0 | 3 | 8.91 | Genic (distinct CNV-subregions); OR > 6 |
| 18 | 338 | 65911512 | 65915538 | 4,026 | loss | 1509 | RTTN | N | 0 | 3 | 8.91 | Genic (distinct CNV-subregions); OR > 6 |
| 18 | 339 | 65915539 | 65916735 | 1,196 | loss | 1276 | RTTN | N | 0 | 4 | 8.91 | Genic (distinct CNV-subregions); OR > 6 |
| 18 | 339 | 65915539 | 65916735 | 1,196 | loss | 1493 | RTTN | N | 0 | 4 | 8.91 | Genic (distinct CNV-subregions); OR > 6 |
| 18 | 339 | 65915539 | 65916735 | 1,196 | loss | 1509 | RTTN | N | 0 | 4 | 8.91 | Genic (distinct CNV-subregions); OR > 6 |
| 18 | 339 | 65915539 | 65916735 | 1,196 | loss | 1663 | RTTN | N | 0 | 4 | 8.91 | Genic (distinct CNV-subregions); OR > 6 |
| 18 | 340 | 65916737 | 65923901 | 7,164 | loss | 1260 | RTTN | N | 0 | 4 | 8.91 | Genic (distinct CNV-subregions); OR > 6 |
| 18 | 340 | 65916737 | 65923901 | 7,164 | loss | 1276 | RTTN | N | 0 | 4 | 8.91 | Genic (distinct CNV-subregions); OR > 6 |
| 18 | 340 | 65916737 | 65923901 | 7,164 | loss | 1613 | RTTN | N | 0 | 4 | 8.91 | Genic (distinct CNV-subregions); OR > 6 |
| 18 | 340 | 65916737 | 65923901 | 7,164 | loss | 1663 | RTTN | N | 0 | 4 | 8.91 | Genic (distinct CNV-subregions); OR > 6 |
| 19 | 341 | 241442 | 244260 | 2,818 | loss | 1565 | PPAP2C | Y | 1 | 3 | 4.44 | Exon+ve, 5 > ASD > 1, Normals < 2, Sanger−ve |
| 19 | 341 | 241442 | 244260 | 2,818 | loss | 1567 | PPAP2C | Y | 1 | 3 | 4.44 | Exon+ve, 5 > ASD > 1, Normals < 2, Sanger−ve |
| 19 | 341 | 241442 | 244260 | 2,818 | loss | 1944 | PPAP2C | Y | 1 | 3 | 4.44 | Exon+ve, 5 > ASD > 1, Normals < 2, Sanger−ve |
| 19 | 342 | 1200840 | 1202175 | 1,335 | loss | 1224 | MIDN | Y | 1 | 34 | 52.68 | Exon+ve, ASD > 4, Normals < 2, no Sanger filter applied |
| 19 | 342 | 1200840 | 1202175 | 1,335 | loss | 1227 | MIDN | Y | 1 | 34 | 52.68 | Exon+ve, ASD > 4, Normals < 2, no Sanger filter applied |
| 19 | 342 | 1200840 | 1202175 | 1,335 | loss | 1230 | MIDN | Y | 1 | 34 | 52.68 | Exon+ve, ASD > 4, Normals < 2, no Sanger filter applied |
| 19 | 342 | 1200840 | 1202175 | 1,335 | loss | 1234 | MIDN | Y | 1 | 34 | 52.68 | Exon+ve, ASD > 4, Normals < 2, no Sanger filter applied |
| 19 | 342 | 1200840 | 1202175 | 1,335 | loss | 1301 | MIDN | Y | 1 | 34 | 52.68 | Exon+ve, ASD > 4, Normals < 2, no Sanger filter applied |
| 19 | 342 | 1200840 | 1202175 | 1,335 | loss | 1416 | MIDN | Y | 1 | 34 | 52.68 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 19 | 342 | 1200840 | 1202175 | 1,335 | loss | 1471 | MIDN | Y | 1 | 34 | 52.68 | Exon+ve, ASD > 4, Normals < 2, no Sanger filter applied |
| 19 | 342 | 1200840 | 1202175 | 1,335 | loss | 1495 | MIDN | Y | 1 | 34 | 52.68 | Exon+ve, ASD > 4, Normals < 2, no Sanger filter applied |
| 19 | 342 | 1200840 | 1202175 | 1,335 | loss | 1503 | MIDN | Y | 1 | 34 | 52.68 | Exon+ve, ASD > 4, Normals < 2, no Sanger filter applied |
| 19 | 342 | 1200840 | 1202175 | 1,335 | loss | 1504 | MIDN | Y | 1 | 34 | 52.68 | Exon+ve, ASD > 4, Normals < 2, no Sanger filter applied |
| 19 | 342 | 1200840 | 1202175 | 1,335 | loss | 1520 | MIDN | Y | 1 | 34 | 52.68 | Exon+ve, ASD > 4, Normals < 2, no Sanger filter applied |
| 19 | 342 | 1200840 | 1202175 | 1,335 | loss | 1527 | MIDN | Y | 1 | 34 | 52.68 | Exon+ve, ASD > 4, Normals < 2, no Sanger filter applied |
| 19 | 342 | 1200840 | 1202175 | 1,335 | loss | 1528 | MIDN | Y | 1 | 34 | 52.68 | Exon+ve, ASD > 4, Normals < 2, no Sanger filter applied |
| 19 | 342 | 1200840 | 1202175 | 1,335 | loss | 1529 | MIDN | Y | 1 | 34 | 52.68 | Exon+ve, ASD > 4, Normals < 2, no Sanger filter applied |
| 19 | 342 | 1200840 | 1202175 | 1,335 | loss | 1532 | MIDN | Y | 1 | 34 | 52.68 | Exon+ve, ASD > 4, Normals < 2, no Sanger filter applied |
| 19 | 342 | 1200840 | 1202175 | 1,335 | loss | 1544 | MIDN | Y | 1 | 34 | 52.68 | Exon+ve, ASD > 4, Normals < 2, no Sanger filter applied |
| 19 | 342 | 1200840 | 1202175 | 1,335 | loss | 1566 | MIDN | Y | 1 | 34 | 52.68 | Exon+ve, ASD > 4, Normals < 2, no Sanger filter applied |
| 19 | 342 | 1200840 | 1202175 | 1,335 | loss | 1574 | MIDN | Y | 1 | 34 | 52.68 | Exon+ve, ASD > 4, Normals < 2, no Sanger filter applied |
| 19 | 342 | 1200840 | 1202175 | 1,335 | loss | 1577 | MIDN | Y | 1 | 34 | 52.68 | Exon+ve, ASD > 4, Normals < 2, no Sanger filter applied |
| 19 | 342 | 1200840 | 1202175 | 1,335 | loss | 1629 | MIDN | Y | 1 | 34 | 52.68 | Exon+ve, ASD > 4, Normals < 2, no Sanger filter applied |
| 19 | 342 | 1200840 | 1202175 | 1,335 | loss | 1672 | MIDN | Y | 1 | 34 | 52.68 | Exon+ve, ASD > 4, Normals < 2, no Sanger filter applied |
| 19 | 342 | 1200840 | 1202175 | 1,335 | loss | 1688 | MIDN | Y | 1 | 34 | 52.68 | Exon+ve, ASD > 4, Normals < 2, no Sanger filter applied |
| 19 | 342 | 1200840 | 1202175 | 1,335 | loss | 1724 | MIDN | Y | 1 | 34 | 52.68 | Exon+ve, ASD > 4, Normals < 2, no Sanger filter applied |
| 19 | 342 | 1200840 | 1202175 | 1,335 | loss | 1728 | MIDN | Y | 1 | 34 | 52.68 | Exon+ve, ASD > 4, Normals < 2, no Sanger filter applied |
| 19 | 342 | 1200840 | 1202175 | 1,335 | loss | 1742 | MIDN | Y | 1 | 34 | 52.68 | Exon+ve, ASD > 4, Normals < 2, no Sanger filter applied |
| 19 | 342 | 1200840 | 1202175 | 1,335 | loss | 1802 | MIDN | Y | 1 | 34 | 52.68 | Exon+ve, ASD > 4, Normals < 2, no Sanger filter applied |
| 19 | 342 | 1200840 | 1202175 | 1,335 | loss | 1827 | MIDN | Y | 1 | 34 | 52.68 | Exon+ve, ASD > 4, Normals < 2, no Sanger filter applied |
| 19 | 342 | 1200840 | 1202175 | 1,335 | loss | 1831 | MIDN | Y | 1 | 34 | 52.68 | Exon+ve, ASD > 4, Normals < 2, no Sanger filter applied |
| 19 | 342 | 1200840 | 1202175 | 1,335 | loss | 1870 | MIDN | Y | 1 | 34 | 52.68 | Exon+ve, ASD > 4, Normals < 2, no Sanger filter applied |
| 19 | 342 | 1200840 | 1202175 | 1,335 | loss | 1883 | MIDN | Y | 1 | 34 | 52.68 | Exon+ve, ASD > 4, Normals < 2, no Sanger filter applied |
| 19 | 342 | 1200840 | 1202175 | 1,335 | loss | 1921 | MIDN | Y | 1 | 34 | 52.68 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 19 | 342 | 1200840 | 1202175 | 1,335 | loss | 1964 | MIDN | Y | 1 | 34 | 52.68 | Exon+ve, ASD > 4, Normals < 2, no Sanger filter applied |
| 19 | 342 | 1200840 | 1202175 | 1,335 | loss | 2018 | MIDN | Y | 1 | 34 | 52.68 | Exon+ve, ASD > 4, Normals < 2, no Sanger filter applied |
| 19 | 342 | 1200840 | 1202175 | 1,335 | loss | 2044 | MIDN | Y | 1 | 34 | 52.68 | Exon+ve, ASD > 4, Normals < 2, no Sanger filter applied |
| 19 | 343 | 1400798 | 1400840 | 42 | loss | 1229 | | N | 1 | 98 | 168.48 | high OR intergenic (OR > 30) |
| 19 | 343 | 1400798 | 1400840 | 42 | gain | 1236 | | N | 1 | 98 | 168.48 | high OR intergenic (OR > 30) |
| 19 | 343 | 1400798 | 1400840 | 42 | gain | 1238 | | N | 1 | 98 | 168.48 | high OR intergenic (OR > 30) |
| 19 | 343 | 1400798 | 1400840 | 42 | gain | 1239 | | N | 1 | 98 | 168.48 | high OR intergenic (OR > 30) |
| 19 | 343 | 1400798 | 1400840 | 42 | gain | 1240 | | N | 1 | 98 | 168.48 | high OR intergenic (OR > 30) |
| 19 | 343 | 1400798 | 1400840 | 42 | gain | 1245 | | N | 1 | 98 | 168.48 | high OR intergenic (OR > 30) |
| 19 | 343 | 1400798 | 1400840 | 42 | gain | 1258 | | N | 1 | 98 | 168.48 | high OR intergenic (OR > 30) |
| 19 | 343 | 1400798 | 1400840 | 42 | gain | 1259 | | N | 1 | 98 | 168.48 | high OR intergenic (OR > 30) |
| 19 | 343 | 1400798 | 1400840 | 42 | gain | 1264 | | N | 1 | 98 | 168.48 | high OR intergenic (OR > 30) |
| 19 | 343 | 1400798 | 1400840 | 42 | gain | 1268 | | N | 1 | 98 | 168.48 | high OR intergenic (OR > 30) |
| 19 | 343 | 1400798 | 1400840 | 42 | gain | 1269 | | N | 1 | 98 | 168.48 | high OR intergenic (OR > 30) |
| 19 | 343 | 1400798 | 1400840 | 42 | gain | 1270 | | N | 1 | 98 | 168.48 | high OR intergenic (OR > 30) |
| 19 | 343 | 1400798 | 1400840 | 42 | gain | 1279 | | N | 1 | 98 | 168.48 | high OR intergenic (OR > 30) |
| 19 | 343 | 1400798 | 1400840 | 42 | gain | 1280 | | N | 1 | 98 | 168.48 | high OR intergenic (OR > 30) |
| 19 | 343 | 1400798 | 1400840 | 42 | gain | 1315 | | N | 1 | 98 | 168.48 | high OR intergenic (OR > 30) |
| 19 | 343 | 1400798 | 1400840 | 42 | gain | 1317 | | N | 1 | 98 | 168.48 | high OR intergenic (OR > 30) |
| 19 | 343 | 1400798 | 1400840 | 42 | gain | 1324 | | N | 1 | 98 | 168.48 | high OR intergenic (OR > 30) |
| 19 | 343 | 1400798 | 1400840 | 42 | loss | 1389 | | N | 1 | 98 | 168.48 | high OR intergenic (OR > 30) |
| 19 | 343 | 1400798 | 1400840 | 42 | gain | 1401 | | N | 1 | 98 | 168.48 | high OR intergenic (OR > 30) |
| 19 | 343 | 1400798 | 1400840 | 42 | gain | 1402 | | N | 1 | 98 | 168.48 | high OR intergenic (OR > 30) |
| 19 | 343 | 1400798 | 1400840 | 42 | gain | 1404 | | N | 1 | 98 | 168.48 | high OR intergenic (OR > 30) |
| 19 | 343 | 1400798 | 1400840 | 42 | gain | 1406 | | N | 1 | 98 | 168.48 | high OR intergenic (OR > 30) |
| 19 | 343 | 1400798 | 1400840 | 42 | loss | 1413 | | N | 1 | 98 | 168.48 | high OR intergenic (OR > 30) |
| 19 | 343 | 1400798 | 1400840 | 42 | loss | 1416 | | N | 1 | 98 | 168.48 | high OR intergenic (OR > 30) |
| 19 | 343 | 1400798 | 1400840 | 42 | gain | 1417 | | N | 1 | 98 | 168.48 | high OR intergenic (OR > 30) |
| 19 | 343 | 1400798 | 1400840 | 42 | gain | 1419 | | N | 1 | 98 | 168.48 | high OR intergenic (OR > 30) |
| 19 | 343 | 1400798 | 1400840 | 42 | gain | 1421 | | N | 1 | 98 | 168.48 | high OR intergenic (OR > 30) |
| 19 | 343 | 1400798 | 1400840 | 42 | gain | 1427 | | N | 1 | 98 | 168.48 | high OR intergenic (OR > 30) |
| 19 | 343 | 1400798 | 1400840 | 42 | gain | 1434 | | N | 1 | 98 | 168.48 | high OR intergenic (OR > 30) |
| 19 | 343 | 1400798 | 1400840 | 42 | gain | 1447 | | N | 1 | 98 | 168.48 | high OR intergenic (OR > 30) |
| 19 | 343 | 1400798 | 1400840 | 42 | loss | 1449 | | N | 1 | 98 | 168.48 | high OR intergenic (OR > 30) |
| 19 | 343 | 1400798 | 1400840 | 42 | loss | 1450 | | N | 1 | 98 | 168.48 | high OR intergenic (OR > 30) |
| 19 | 343 | 1400798 | 1400840 | 42 | loss | 1452 | | N | 1 | 98 | 168.48 | high OR intergenic (OR > 30) |
| 19 | 343 | 1400798 | 1400840 | 42 | loss | 1461 | | N | 1 | 98 | 168.48 | high OR intergenic (OR > 30) |
| 19 | 343 | 1400798 | 1400840 | 42 | loss | 1466 | | N | 1 | 98 | 168.48 | high OR intergenic (OR > 30) |
| 19 | 343 | 1400798 | 1400840 | 42 | loss | 1504 | | N | 1 | 98 | 168.48 | high OR intergenic (OR > 30) |
| 19 | 343 | 1400798 | 1400840 | 42 | loss | 1505 | | N | 1 | 98 | 168.48 | high OR intergenic (OR > 30) |
| 19 | 343 | 1400798 | 1400840 | 42 | gain | 1510 | | N | 1 | 98 | 168.48 | high OR intergenic (OR > 30) |
| 19 | 343 | 1400798 | 1400840 | 42 | gain | 1524 | | N | 1 | 98 | 168.48 | high OR intergenic (OR > 30) |
| 19 | 343 | 1400798 | 1400840 | 42 | loss | 1529 | | N | 1 | 98 | 168.48 | high OR intergenic (OR > 30) |
| 19 | 343 | 1400798 | 1400840 | 42 | gain | 1530 | | N | 1 | 98 | 168.48 | high OR intergenic (OR > 30) |
| 19 | 343 | 1400798 | 1400840 | 42 | gain | 1532 | | N | 1 | 98 | 168.48 | high OR intergenic (OR > 30) |
| 19 | 343 | 1400798 | 1400840 | 42 | gain | 1534 | | N | 1 | 98 | 168.48 | high OR intergenic (OR > 30) |
| 19 | 343 | 1400798 | 1400840 | 42 | gain | 1541 | | N | 1 | 98 | 168.48 | high OR intergenic (OR > 30) |
| 19 | 343 | 1400798 | 1400840 | 42 | gain | 1543 | | N | 1 | 98 | 168.48 | high OR intergenic (OR > 30) |
| 19 | 343 | 1400798 | 1400840 | 42 | loss | 1548 | | N | 1 | 98 | 168.48 | high OR intergenic (OR > 30) |
| 19 | 343 | 1400798 | 1400840 | 42 | loss | 1559 | | N | 1 | 98 | 168.48 | high OR intergenic (OR > 30) |
| 19 | 343 | 1400798 | 1400840 | 42 | gain | 1570 | | N | 1 | 98 | 168.48 | high OR intergenic (OR > 30) |
| 19 | 343 | 1400798 | 1400840 | 42 | loss | 1572 | | N | 1 | 98 | 168.48 | high OR intergenic (OR > 30) |
| 19 | 343 | 1400798 | 1400840 | 42 | loss | 1574 | | N | 1 | 98 | 168.48 | high OR intergenic (OR > 30) |
| 19 | 343 | 1400798 | 1400840 | 42 | gain | 1576 | | N | 1 | 98 | 168.48 | high OR intergenic (OR > 30) |
| 19 | 343 | 1400798 | 1400840 | 42 | gain | 1587 | | N | 1 | 98 | 168.48 | high OR intergenic (OR > 30) |
| 19 | 343 | 1400798 | 1400840 | 42 | gain | 1592 | | N | 1 | 98 | 168.48 | high OR intergenic (OR > 30) |
| 19 | 343 | 1400798 | 1400840 | 42 | gain | 1594 | | N | 1 | 98 | 168.48 | high OR intergenic (OR > 30) |
| 19 | 343 | 1400798 | 1400840 | 42 | gain | 1596 | | N | 1 | 98 | 168.48 | high OR intergenic (OR > 30) |
| 19 | 343 | 1400798 | 1400840 | 42 | gain | 1600 | | N | 1 | 98 | 168.48 | high OR intergenic (OR > 30) |
| 19 | 343 | 1400798 | 1400840 | 42 | gain | 1612 | | N | 1 | 98 | 168.48 | high OR intergenic (OR > 30) |
| 19 | 343 | 1400798 | 1400840 | 42 | gain | 1630 | | N | 1 | 98 | 168.48 | high OR intergenic (OR > 30) |
| 19 | 343 | 1400798 | 1400840 | 42 | gain | 1633 | | N | 1 | 98 | 168.48 | high OR intergenic (OR > 30) |
| 19 | 343 | 1400798 | 1400840 | 42 | gain | 1637 | | N | 1 | 98 | 168.48 | high OR intergenic (OR > 30) |
| 19 | 343 | 1400798 | 1400840 | 42 | gain | 1661 | | N | 1 | 98 | 168.48 | high OR intergenic (OR > 30) |
| 19 | 343 | 1400798 | 1400840 | 42 | loss | 1672 | | N | 1 | 98 | 168.48 | high OR intergenic (OR > 30) |
| 19 | 343 | 1400798 | 1400840 | 42 | loss | 1687 | | N | 1 | 98 | 168.48 | high OR intergenic (OR > 30) |
| 19 | 343 | 1400798 | 1400840 | 42 | loss | 1724 | | N | 1 | 98 | 168.48 | high OR intergenic (OR > 30) |
| 19 | 343 | 1400798 | 1400840 | 42 | gain | 1807 | | N | 1 | 98 | 168.48 | high OR intergenic (OR > 30) |
| 19 | 343 | 1400798 | 1400840 | 42 | loss | 1827 | | N | 1 | 98 | 168.48 | high OR intergenic (OR > 30) |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 19 | 343 | 1400798 | 1400840 | 42 | loss | 1828 | | N | 1 | 98 | 168.48 | high OR intergenic (OR > 30) |
| 19 | 343 | 1400798 | 1400840 | 42 | loss | 1829 | | N | 1 | 98 | 168.48 | high OR intergenic (OR > 30) |
| 19 | 343 | 1400798 | 1400840 | 42 | loss | 1835 | | N | 1 | 98 | 168.48 | high OR intergenic (OR > 30) |
| 19 | 343 | 1400798 | 1400840 | 42 | gain | 1837 | | N | 1 | 98 | 168.48 | high OR intergenic (OR > 30) |
| 19 | 343 | 1400798 | 1400840 | 42 | gain | 1841 | | N | 1 | 98 | 168.48 | high OR intergenic (OR > 30) |
| 19 | 343 | 1400798 | 1400840 | 42 | gain | 1842 | | N | 1 | 98 | 168.48 | high OR intergenic (OR > 30) |
| 19 | 343 | 1400798 | 1400840 | 42 | gain | 1862 | | N | 1 | 98 | 168.48 | high OR intergenic (OR > 30) |
| 19 | 343 | 1400798 | 1400840 | 42 | gain | 1864 | | N | 1 | 98 | 168.48 | high OR intergenic (OR > 30) |
| 19 | 343 | 1400798 | 1400840 | 42 | gain | 1871 | | N | 1 | 98 | 168.48 | high OR intergenic (OR > 30) |
| 19 | 343 | 1400798 | 1400840 | 42 | gain | 1872 | | N | 1 | 98 | 168.48 | high OR intergenic (OR > 30) |
| 19 | 343 | 1400798 | 1400840 | 42 | loss | 1874 | | N | 1 | 98 | 168.48 | high OR intergenic (OR > 30) |
| 19 | 343 | 1400798 | 1400840 | 42 | gain | 1876 | | N | 1 | 98 | 168.48 | high OR intergenic (OR > 30) |
| 19 | 343 | 1400798 | 1400840 | 42 | gain | 1885 | | N | 1 | 98 | 168.48 | high OR intergenic (OR > 30) |
| 19 | 343 | 1400798 | 1400840 | 42 | loss | 1888 | | N | 1 | 98 | 168.48 | high OR intergenic (OR > 30) |
| 19 | 343 | 1400798 | 1400840 | 42 | gain | 1909 | | N | 1 | 98 | 168.48 | high OR intergenic (OR > 30) |
| 19 | 343 | 1400798 | 1400840 | 42 | loss | 1913 | | N | 1 | 98 | 168.48 | high OR intergenic (OR > 30) |
| 19 | 343 | 1400798 | 1400840 | 42 | loss | 1914 | | N | 1 | 98 | 168.48 | high OR intergenic (OR > 30) |
| 19 | 343 | 1400798 | 1400840 | 42 | gain | 1917 | | N | 1 | 98 | 168.48 | high OR intergenic (OR > 30) |
| 19 | 343 | 1400798 | 1400840 | 42 | gain | 1926 | | N | 1 | 98 | 168.48 | high OR intergenic (OR > 30) |
| 19 | 343 | 1400798 | 1400840 | 42 | gain | 1928 | | N | 1 | 98 | 168.48 | high OR intergenic (OR > 30) |
| 19 | 343 | 1400798 | 1400840 | 42 | gain | 1931 | | N | 1 | 98 | 168.48 | high OR intergenic (OR > 30) |
| 19 | 343 | 1400798 | 1400840 | 42 | loss | 1934 | | N | 1 | 98 | 168.48 | high OR intergenic (OR > 30) |
| 19 | 343 | 1400798 | 1400840 | 42 | gain | 1951 | | N | 1 | 98 | 168.48 | high OR intergenic (OR > 30) |
| 19 | 343 | 1400798 | 1400840 | 42 | loss | 1959 | | N | 1 | 98 | 168.48 | high OR intergenic (OR > 30) |
| 19 | 343 | 1400798 | 1400840 | 42 | loss | 1964 | | N | 1 | 98 | 168.48 | high OR intergenic (OR > 30) |
| 19 | 343 | 1400798 | 1400840 | 42 | gain | 2006 | | N | 1 | 98 | 168.48 | high OR intergenic (OR > 30) |
| 19 | 343 | 1400798 | 1400840 | 42 | gain | 2024 | | N | 1 | 98 | 168.48 | high OR intergenic (OR > 30) |
| 19 | 343 | 1400798 | 1400840 | 42 | gain | 2029 | | N | 1 | 98 | 168.48 | high OR intergenic (OR > 30) |
| 19 | 343 | 1400798 | 1400840 | 42 | gain | 2030 | | N | 1 | 98 | 168.48 | high OR intergenic (OR > 30) |
| 19 | 343 | 1400798 | 1400840 | 42 | gain | 2041 | | N | 1 | 98 | 168.48 | high OR intergenic (OR > 30) |
| 19 | 343 | 1400798 | 1400840 | 42 | gain | 2042 | | N | 1 | 98 | 168.48 | high OR intergenic (OR > 30) |
| 19 | 343 | 1400798 | 1400840 | 42 | loss | 2044 | | N | 1 | 98 | 168.48 | high OR intergenic (OR > 30) |
| 19 | 344 | 13993305 | 14014612 | 21,307 | gain | 1461 | IL27RA, RLN3 | Y | 1 | 2 | 2.95 | Exon+ve, 5 > ASD > 1, Normals < 2, Sanger−ve |
| 19 | 344 | 13993305 | 14014612 | 21,307 | gain | 1878 | IL27RA, RLN3 | Y | 1 | 2 | 2.95 | Exon+ve, 5 > ASD > 1, Normals < 2, Sanger−ve |
| 19 | 345 | 20146625 | 20221909 | 75,284 | loss | 1577 | ZNF486 | Y | 1 | 2 | 2.95 | Exon+ve, 5 > ASD > 1, Normals < 2, Sanger−ve |
| 19 | 345 | 20146625 | 20221909 | 75,284 | loss | 1918 | ZNF486 | Y | 1 | 2 | 2.95 | Exon+ve, 5 > ASD > 1, Normals < 2, Sanger−ve |
| 19 | 346 | 20510788 | 20517399 | 6,611 | loss | 1333 | ZNF737 | Y | 1 | 4 | 5.92 | Exon+ve, 5 > ASD > 1, Normals < 2, Sanger−ve |
| 19 | 346 | 20510788 | 20517399 | 6,611 | loss | 1416 | ZNF737 | Y | 1 | 4 | 5.92 | Exon+ve, 5 > ASD > 1, Normals < 2, Sanger−ve |
| 19 | 346 | 20510788 | 20517399 | 6,611 | loss | 1781 | ZNF737 | Y | 1 | 4 | 5.92 | Exon+ve, 5 > ASD > 1, Normals < 2, Sanger−ve |
| 19 | 346 | 20510788 | 20517399 | 6,611 | loss | 1918 | ZNF737 | Y | 1 | 4 | 5.92 | Exon+ve, 5 > ASD > 1, Normals < 2, Sanger−ve |
| 19 | 347 | 23786449 | 23790608 | 4,159 | gain | 1323 | RPSAP58 | N | 0 | 12 | 17.98 | Intron+ve, ASD > 4, Normals < 2, no Sanger filter applied |
| 19 | 347 | 23786449 | 23790608 | 4,159 | gain | 1509 | RPSAP58 | N | 0 | 12 | 17.98 | Intron+ve, ASD > 4, Normals < 2, no Sanger filter applied |
| 19 | 347 | 23786449 | 23790608 | 4,159 | gain | 1541 | RPSAP58 | N | 0 | 12 | 17.98 | Intron+ve, ASD > 4, Normals < 2, no Sanger filter applied |
| 19 | 347 | 23786449 | 23790608 | 4,159 | gain | 1585 | RPSAP58 | N | 0 | 12 | 17.98 | Intron+ve, ASD > 4, Normals < 2, no Sanger filter applied |
| 19 | 347 | 23786449 | 23790608 | 4,159 | gain | 1587 | RPSAP58 | N | 0 | 12 | 17.98 | Intron+ve, ASD > 4, Normals < 2, no Sanger filter applied |
| 19 | 347 | 23786449 | 23790608 | 4,159 | gain | 1606 | RPSAP58 | N | 0 | 12 | 17.98 | Intron+ve, ASD > 4, Normals < 2, no Sanger filter applied |
| 19 | 347 | 23786449 | 23790608 | 4,159 | gain | 1608 | RPSAP58 | N | 0 | 12 | 17.98 | Intron+ve, ASD > 4, Normals < 2, no Sanger filter applied |
| 19 | 347 | 23786449 | 23790608 | 4,159 | gain | 1612 | RPSAP58 | N | 0 | 12 | 17.98 | Intron+ve, ASD > 4, Normals < 2, no Sanger filter applied |
| 19 | 347 | 23786449 | 23790608 | 4,159 | gain | 1775 | RPSAP58 | N | 0 | 12 | 17.98 | Intron+ve, ASD > 4, Normals < 2, no Sanger filter applied |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 19 | 347 | 23786449 | 23790608 | 4,159 | gain | 1777 | RPSAP58 | N | 0 | 12 | 17.98 | Intron+ve, ASD > 4, Normals < 2, no Sanger filter applied |
| 19 | 347 | 23786449 | 23790608 | 4,159 | gain | 1783 | RPSAP58 | N | 0 | 12 | 17.98 | Intron+ve, ASD > 4, Normals < 2, no Sanger filter applied |
| 19 | 347 | 23786449 | 23790608 | 4,159 | gain | 2041 | RPSAP58 | N | 0 | 12 | 17.98 | Intron+ve, ASD > 4, Normals < 2, no Sanger filter applied |
| 19 | 348 | 23790609 | 23800104 | 9,495 | gain | 1323 | RPSAP58 | N | 0 | 9 | 13.43 | Intron+ve, ASD > 4, Normals < 2, no Sanger filter applied |
| 19 | 348 | 23790609 | 23800104 | 9,495 | gain | 1509 | RPSAP58 | N | 0 | 9 | 13.43 | Intron+ve, ASD > 4, Normals < 2, no Sanger filter applied |
| 19 | 348 | 23790609 | 23800104 | 9,495 | gain | 1541 | RPSAP58 | N | 0 | 9 | 13.43 | Intron+ve, ASD > 4, Normals < 2, no Sanger filter applied |
| 19 | 348 | 23790609 | 23800104 | 9,495 | gain | 1585 | RPSAP58 | N | 0 | 9 | 13.43 | Intron+ve, ASD > 4, Normals < 2, no Sanger filter applied |
| 19 | 348 | 23790609 | 23800104 | 9,495 | gain | 1587 | RPSAP58 | N | 0 | 9 | 13.43 | Intron+ve, ASD > 4, Normals < 2, no Sanger filter applied |
| 19 | 348 | 23790609 | 23800104 | 9,495 | gain | 1606 | RPSAP58 | N | 0 | 9 | 13.43 | Intron+ve, ASD > 4, Normals < 2, no Sanger filter applied |
| 19 | 348 | 23790609 | 23800104 | 9,495 | gain | 1608 | RPSAP58 | N | 0 | 9 | 13.43 | Intron+ve, ASD > 4, Normals < 2, no Sanger filter applied |
| 19 | 348 | 23790609 | 23800104 | 9,495 | gain | 1612 | RPSAP58 | N | 0 | 9 | 13.43 | Intron+ve, ASD > 4, Normals < 2, no Sanger filter applied |
| 19 | 348 | 23790609 | 23800104 | 9,495 | gain | 1783 | RPSAP58 | N | 0 | 9 | 13.43 | Intron+ve, ASD > 4, Normals < 2, no Sanger filter applied |
| 19 | 349 | 42530955 | 42537227 | 6,272 | loss | 1348 | HKR1 | N | 0 | 5 | 7.42 | Intron+ve, ASD > 4, Normals < 2, no Sanger filter applied |
| 19 | 349 | 42530955 | 42537227 | 6,272 | loss | 1459 | HKR1 | N | 0 | 5 | 7.42 | Intron+ve, ASD > 4, Normals < 2, no Sanger filter applied |
| 19 | 349 | 42530955 | 42537227 | 6,272 | loss | 1684 | HKR1 | N | 0 | 5 | 7.42 | Intron+ve, ASD > 4, Normals < 2, no Sanger filter applied |
| 19 | 349 | 42530955 | 42537227 | 6,272 | loss | 1816 | HKR1 | N | 0 | 5 | 7.42 | Intron+ve, ASD > 4, Normals < 2, no Sanger filter applied |
| 19 | 349 | 42530955 | 42537227 | 6,272 | loss | 2024 | HKR1 | N | 0 | 5 | 7.42 | Intron+ve, ASD > 4, Normals < 2, no Sanger filter applied |
| 19 | 350 | 42537228 | 42537766 | 538 | loss | 1348 | HKR1 | N | 0 | 8 | 11.92 | Intron+ve, ASD > 4, Normals < 2, no Sanger filter applied |
| 19 | 350 | 42537228 | 42537766 | 538 | loss | 1402 | HKR1 | N | 0 | 8 | 11.92 | Intron+ve, ASD > 4, Normals < 2, no Sanger filter applied |
| 19 | 350 | 42537228 | 42537766 | 538 | loss | 1459 | HKR1 | N | 0 | 8 | 11.92 | Intron+ve, ASD > 4, Normals < 2, no Sanger filter applied |
| 19 | 350 | 42537228 | 42537766 | 538 | loss | 1528 | HKR1 | N | 0 | 8 | 11.92 | Intron+ve, ASD > 4, Normals < 2, no Sanger filter applied |
| 19 | 350 | 42537228 | 42537766 | 538 | loss | 1658 | HKR1 | N | 0 | 8 | 11.92 | Intron+ve, ASD > 4, Normals < 2, no Sanger filter applied |
| 19 | 350 | 42537228 | 42537766 | 538 | loss | 1684 | HKR1 | N | 0 | 8 | 11.92 | Intron+ve, ASD > 4, Normals < 2, no Sanger filter applied |
| 19 | 350 | 42537228 | 42537766 | 538 | loss | 1816 | HKR1 | N | 0 | 8 | 11.92 | Intron+ve, ASD > 4, Normals < 2, no Sanger filter applied |
| 19 | 350 | 42537228 | 42537766 | 538 | loss | 2024 | HKR1 | N | 0 | 8 | 11.92 | Intron+ve, ASD > 4, Normals < 2, no Sanger filter applied |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 19 | 351 | 46032427 | 46046858 | 14,431 | gain | 1229 | CYP2A6 | Y | 1 | 5 | 7.42 | Exon+ve, ASD > 4, Normals < 2, no Sanger filter applied |
| 19 | 351 | 46032427 | 46046858 | 14,431 | gain | 1395 | CYP2A6 | Y | 1 | 5 | 7.42 | Exon+ve, ASD > 4, Normals < 2, no Sanger filter applied |
| 19 | 351 | 46032427 | 46046858 | 14,431 | gain | 1538 | CYP2A6 | Y | 1 | 5 | 7.42 | Exon+ve, ASD > 4, Normals < 2, no Sanger filter applied |
| 19 | 351 | 46032427 | 46046858 | 14,431 | gain | 1869 | CYP2A6 | Y | 1 | 5 | 7.42 | Exon+ve, ASD > 4, Normals < 2, no Sanger filter applied |
| 19 | 351 | 46032427 | 46046858 | 14,431 | gain | 2020 | CYP2A6 | Y | 1 | 5 | 7.42 | Exon+ve, ASD > 4, Normals < 2, no Sanger filter applied |
| 19 | 352 | 48536891 | 48551450 | 14,559 | loss | 1786 | CD177, PRG1 | Y | 1 | 2 | 2.95 | Exon+ve, 5 > ASD > 1, Normals < 2, Sanger−ve |
| 19 | 352 | 48536891 | 48551450 | 14,559 | loss | 1899 | CD177, PRG1 | Y | 1 | 2 | 2.95 | Exon+ve, 5 > ASD > 1, Normals < 2, Sanger−ve |
| 19 | 353 | 52315524 | 52339852 | 24,328 | gain | 1393 | SAE1 | Y | 1 | 4 | 5.92 | Exon+ve, 5 > ASD > 1, Normals < 2, Sanger−ve |
| 19 | 353 | 52315524 | 52339852 | 24,328 | gain | 1814 | SAE1 | Y | 1 | 4 | 5.92 | Exon+ve, 5 > ASD > 1, Normals < 2, Sanger−ve |
| 19 | 353 | 52315524 | 52339852 | 24,328 | gain | 1871 | SAE1 | Y | 1 | 4 | 5.92 | Exon+ve, 5 > ASD > 1, Normals < 2, Sanger−ve |
| 19 | 353 | 52315524 | 52339852 | 24,328 | gain | 1924 | SAE1 | Y | 1 | 4 | 5.92 | Exon+ve, 5 > ASD > 1, Normals < 2, Sanger−ve |
| 19 | 354 | 58208527 | 58212112 | 3,585 | gain | 1287 | HERV-V1 | Y | 2 | 12 | 8.98 | Genic (distinct CNV-subregions); OR > 6 |
| 19 | 354 | 58208527 | 58212112 | 3,585 | gain | 1337 | HERV-V1 | Y | 2 | 12 | 8.98 | Genic (distinct CNV-subregions); OR > 6 |
| 19 | 354 | 58208527 | 58212112 | 3,585 | gain | 1348 | HERV-V1 | Y | 2 | 12 | 8.98 | Genic (distinct CNV-subregions); OR > 6 |
| 19 | 354 | 58208527 | 58212112 | 3,585 | gain | 1424 | HERV-V1 | Y | 2 | 12 | 8.98 | Genic (distinct CNV-subregions); OR > 6 |
| 19 | 354 | 58208527 | 58212112 | 3,585 | gain | 1458 | HERV-V1 | Y | 2 | 12 | 8.98 | Genic (distinct CNV-subregions); OR > 6 |
| 19 | 354 | 58208527 | 58212112 | 3,585 | gain | 1505 | HERV-V1 | Y | 2 | 12 | 8.98 | Genic (distinct CNV-subregions); OR > 6 |
| 19 | 354 | 58208527 | 58212112 | 3,585 | gain | 1511 | HERV-V1 | Y | 2 | 12 | 8.98 | Genic (distinct CNV-subregions); OR > 6 |
| 19 | 354 | 58208527 | 58212112 | 3,585 | gain | 1529 | HERV-V1 | Y | 2 | 12 | 8.98 | Genic (distinct CNV-subregions); OR > 6 |
| 19 | 354 | 58208527 | 58212112 | 3,585 | gain | 1633 | HERV-V1 | Y | 2 | 12 | 8.98 | Genic (distinct CNV-subregions); OR > 6 |
| 19 | 354 | 58208527 | 58212112 | 3,585 | gain | 1646 | HERV-V1 | Y | 2 | 12 | 8.98 | Genic (distinct CNV-subregions); OR > 6 |
| 19 | 354 | 58208527 | 58212112 | 3,585 | gain | 1649 | HERV-V1 | Y | 2 | 12 | 8.98 | Genic (distinct CNV-subregions); OR > 6 |
| 19 | 354 | 58208527 | 58212112 | 3,585 | gain | 1786 | HERV-V1 | Y | 2 | 12 | 8.98 | Genic (distinct CNV-subregions); OR > 6 |
| 19 | 355 | 58920524 | 58923614 | 3,090 | gain | 1606 | MIR516B2, MIR526A2 | Y | 1 | 3 | 4.44 | Exon+ve, 5 > ASD > 1, Normals < 2, Sanger−ve |
| 19 | 355 | 58920524 | 58923614 | 3,090 | gain | 1914 | MIR516B2, MIR526A2 | Y | 1 | 3 | 4.44 | Exon+ve, 5 > ASD > 1, Normals < 2, Sanger−ve |
| 19 | 355 | 58920524 | 58923614 | 3,090 | gain | 1966 | MIR516B2, MIR526A2 | Y | 1 | 3 | 4.44 | Exon+ve, 5 > ASD > 1, Normals < 2, Sanger−ve |
| 19 | 356 | 58923615 | 58927377 | 3,762 | gain | 1914 | MIR518A1, MIR518E | Y | 1 | 2 | 2.95 | Exon+ve, 5 > ASD > 1, Normals < 2, Sanger−ve |
| 19 | 356 | 58923615 | 58927377 | 3,762 | gain | 1966 | MIR518A1, MIR518E | Y | 1 | 2 | 2.95 | Exon+ve, 5 > ASD > 1, Normals < 2, Sanger−ve |
| 19 | 357 | 59411618 | 59414644 | 3,026 | loss | 1230 | LILRB3 | Y | 1 | 10 | 14.94 | Exon+ve, ASD > 4, Normals < 2, no Sanger filter applied |
| 19 | 357 | 59411618 | 59414644 | 3,026 | loss | 1346 | LILRB3 | Y | 1 | 10 | 14.94 | Exon+ve, ASD > 4, Normals < 2, no Sanger filter applied |
| 19 | 357 | 59411618 | 59414644 | 3,026 | loss | 1392 | LILRB3 | Y | 1 | 10 | 14.94 | Exon+ve, ASD > 4, Normals < 2, no Sanger filter applied |
| 19 | 357 | 59411618 | 59414644 | 3,026 | loss | 1429 | LILRB3 | Y | 1 | 10 | 14.94 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 19 | 357 | 59411618 | 59414644 | 3,026 | loss | 1616 | LILRB3 | Y | 1 | 10 | 14.94 | Exon+ve, ASD > 4, Normals < 2, no Sanger filter applied |
| 19 | 357 | 59411618 | 59414644 | 3,026 | loss | 1635 | LILRB3 | Y | 1 | 10 | 14.94 | Exon+ve, ASD > 4, Normals < 2, no Sanger filter applied |
| 19 | 357 | 59411618 | 59414644 | 3,026 | loss | 1803 | LILRB3 | Y | 1 | 10 | 14.94 | Exon+ve, ASD > 4, Normals < 2, no Sanger filter applied |
| 19 | 357 | 59411618 | 59414644 | 3,026 | loss | 1804 | LILRB3 | Y | 1 | 10 | 14.94 | Exon+ve, ASD > 4, Normals < 2, no Sanger filter applied |
| 19 | 357 | 59411618 | 59414644 | 3,026 | loss | 1875 | LILRB3 | Y | 1 | 10 | 14.94 | Exon+ve, ASD > 4, Normals < 2, no Sanger filter applied |
| 19 | 357 | 59411618 | 59414644 | 3,026 | loss | 2006 | LILRB3 | Y | 1 | 10 | 14.94 | Exon+ve, ASD > 4, Normals < 2, no Sanger filter applied |
| 19 | 358 | 59864456 | 59865970 | 1,514 | loss | 1627 | LILRB4 | Y | 1 | 2 | 2.95 | Exon+ve, 5 > ASD > 1, Normals < 2, Sanger-ve |
| 19 | 358 | 59864456 | 59865970 | 1,514 | gain | 1751 | LILRB4 | Y | 1 | 2 | 2.95 | Exon+ve, 5 > ASD > 1, Normals < 2, Sanger-ve |
| 19 | 359 | 63698020 | 63704294 | 6,274 | gain | 1571 | SLC27A5 | Y | 1 | 2 | 2.95 | Exon+ve, 5 > ASD > 1, Normals < 2, Sanger-ve |
| 19 | 359 | 63698020 | 63704294 | 6,274 | gain | 1862 | SLC27A5 | Y | 1 | 2 | 2.95 | Exon+ve, 5 > ASD > 1, Normals < 2, Sanger-ve |
| 20 | 360 | 1544486 | 1546858 | 2,372 | gain | 1298 | SIRPB1 | N | 0 | 5 | 7.42 | Intron+ve, ASD > 4, Normals < 2, no Sanger filter applied |
| 20 | 360 | 1544486 | 1546858 | 2,372 | gain | 1449 | SIRPB1 | N | 0 | 5 | 7.42 | Intron+ve, ASD > 4, Normals < 2, no Sanger filter applied |
| 20 | 360 | 1544486 | 1546858 | 2,372 | gain | 1473 | SIRPB1 | N | 0 | 5 | 7.42 | Intron+ve, ASD > 4, Normals < 2, no Sanger filter applied |
| 20 | 360 | 1544486 | 1546858 | 2,372 | gain | 1722 | SIRPB1 | N | 0 | 5 | 7.42 | Intron+ve, ASD > 4, Normals < 2, no Sanger filter applied |
| 20 | 360 | 1544486 | 1546858 | 2,372 | gain | 1935 | SIRPB1 | N | 0 | 5 | 7.42 | Intron+ve, ASD > 4, Normals < 2, no Sanger filter applied |
| 20 | 361 | 26173124 | 28250082 | 2,076,958 | gain | 1285 | FRG1B | Y | 0 | 10 | 14.94 | Exon+ve, ASD > 4, Normals < 2, no Sanger filter applied |
| 20 | 361 | 26173124 | 28250082 | 2,076,958 | gain | 1392 | FRG1B | Y | 0 | 10 | 14.94 | Exon+ve, ASD > 4, Normals < 2, no Sanger filter applied |
| 20 | 361 | 26173124 | 28250082 | 2,076,958 | gain | 1401 | FRG1B | Y | 0 | 10 | 14.94 | Exon+ve, ASD > 4, Normals < 2, no Sanger filter applied |
| 20 | 361 | 26173124 | 28250082 | 2,076,958 | gain | 1405 | FRG1B | Y | 0 | 10 | 14.94 | Exon+ve, ASD > 4, Normals < 2, no Sanger filter applied |
| 20 | 361 | 26173124 | 28250082 | 2,076,958 | gain | 1422 | FRG1B | Y | 0 | 10 | 14.94 | Exon+ve, ASD > 4, Normals < 2, no Sanger filter applied |
| 20 | 361 | 26173124 | 28250082 | 2,076,958 | gain | 1429 | FRG1B | Y | 0 | 10 | 14.94 | Exon+ve, ASD > 4, Normals < 2, no Sanger filter applied |
| 20 | 361 | 26173124 | 28250082 | 2,076,958 | gain | 1571 | FRG1B | Y | 0 | 10 | 14.94 | Exon+ve, ASD > 4, Normals < 2, no Sanger filter applied |
| 20 | 361 | 26173124 | 28250082 | 2,076,958 | gain | 1694 | FRG1B | Y | 0 | 10 | 14.94 | Exon+ve, ASD > 4, Normals < 2, no Sanger filter applied |
| 20 | 361 | 26173124 | 28250082 | 2,076,958 | gain | 1865 | FRG1B | Y | 0 | 10 | 14.94 | Exon+ve, ASD > 4, Normals < 2, no Sanger filter applied |
| 20 | 361 | 26173124 | 28250082 | 2,076,958 | gain | 1875 | FRG1B | Y | 0 | 10 | 14.94 | Exon+ve, ASD > 4, Normals < 2, no Sanger filter applied |
| 20 | 362 | 45217841 | 45220204 | 2,363 | loss | 1475 | EYA2 | N | 1 | 7 | 10.41 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 20 | 362 | 45217841 | 45220204 | 2,363 | loss | 1533 | EYA2 | N | 1 | 7 | 10.41 | Intron+ve, ASD > 4, Normals < 2, no Sanger filter applied |
| 20 | 362 | 45217841 | 45220204 | 2,363 | loss | 1572 | EYA2 | N | 1 | 7 | 10.41 | Intron+ve, ASD > 4, Normals < 2, no Sanger filter applied |
| 20 | 362 | 45217841 | 45220204 | 2,363 | loss | 1632 | EYA2 | N | 1 | 7 | 10.41 | Intron+ve, ASD > 4, Normals < 2, no Sanger filter applied |
| 20 | 362 | 45217841 | 45220204 | 2,363 | loss | 1734 | EYA2 | N | 1 | 7 | 10.41 | Intron+ve, ASD > 4, Normals < 2, no Sanger filter applied |
| 20 | 362 | 45217841 | 45220204 | 2,363 | loss | 1742 | EYA2 | N | 1 | 7 | 10.41 | Intron+ve, ASD > 4, Normals < 2, no Sanger filter applied |
| 20 | 362 | 45217841 | 45220204 | 2,363 | loss | 1887 | EYA2 | N | 1 | 7 | 10.41 | Intron+ve, ASD > 4, Normals < 2, no Sanger filter applied |
| 20 | 363 | 52090394 | 52092989 | 2,595 | loss | 1472 | BCAS1 | N | 1 | 6 | 8.91 | Intron+ve, ASD > 4, Normals < 2, no Sanger filter applied |
| 20 | 363 | 52090394 | 52092989 | 2,595 | loss | 1490 | BCAS1 | N | 1 | 6 | 8.91 | Intron+ve, ASD > 4, Normals < 2, no Sanger filter applied |
| 20 | 363 | 52090394 | 52092989 | 2,595 | loss | 1595 | BCAS1 | N | 1 | 6 | 8.91 | Intron+ve, ASD > 4, Normals < 2, no Sanger filter applied |
| 20 | 363 | 52090394 | 52092989 | 2,595 | loss | 1721 | BCAS1 | N | 1 | 6 | 8.91 | Intron+ve, ASD > 4, Normals < 2, no Sanger filter applied |
| 20 | 363 | 52090394 | 52092989 | 2,595 | loss | 1876 | BCAS1 | N | 1 | 6 | 8.91 | Intron+ve, ASD > 4, Normals < 2, no Sanger filter applied |
| 20 | 363 | 52090394 | 52092989 | 2,595 | loss | 2043 | BCAS1 | N | 1 | 6 | 8.91 | Intron+ve, ASD > 4, Normals < 2, no Sanger filter applied |
| 20 | 364 | 61130661 | 61131984 | 1,323 | gain | 1625 | LOC63930 | N | 1 | 5 | 7.42 | Intron+ve, ASD > 4, Normals < 2, no Sanger filter applied |
| 20 | 364 | 61130661 | 61131984 | 1,323 | gain | 1699 | LOC63930 | N | 1 | 5 | 7.42 | Intron+ve, ASD > 4, Normals < 2, no Sanger filter applied |
| 20 | 364 | 61130661 | 61131984 | 1,323 | loss | 1773 | LOC63930 | N | 1 | 5 | 7.42 | Intron+ve, ASD > 4, Normals < 2, no Sanger filter applied |
| 20 | 364 | 61130661 | 61131984 | 1,323 | loss | 1821 | LOC63930 | N | 1 | 5 | 7.42 | Intron+ve, ASD > 4, Normals < 2, no Sanger filter applied |
| 20 | 364 | 61130661 | 61131984 | 1,323 | loss | 1886 | LOC63930 | N | 1 | 5 | 7.42 | Intron+ve, ASD > 4, Normals < 2, no Sanger filter applied |
| 20 | 365 | 61131985 | 61136457 | 4,472 | gain | 1699 | LOC63930, NCRNA00029 | Y | 1 | 3 | 4.44 | Exon+ve, 5 > ASD > 1, Normals < 2, Sanger-ve |
| 20 | 365 | 61131985 | 61136457 | 4,472 | loss | 1773 | LOC63930, NCRNA00029 | Y | 1 | 3 | 4.44 | Exon+ve, 5 > ASD > 1, Normals < 2, Sanger-ve |
| 20 | 365 | 61131985 | 61136457 | 4,472 | loss | 1821 | LOC63930, NCRNA00029 | Y | 1 | 3 | 4.44 | Exon+ve, 5 > ASD > 1, Normals < 2, Sanger-ve |
| 20 | 366 | 61195158 | 61204000 | 8,842 | gain | 1262 | HAR1B, HAR1A | Y | 1 | 6 | 8.91 | Exon+ve, ASD > 4, Normals < 2, no Sanger filter applied |
| 20 | 366 | 61195158 | 61204000 | 8,842 | gain | 1324 | HAR1B, HAR1A | Y | 1 | 6 | 8.91 | Exon+ve, ASD > 4, Normals < 2, no Sanger filter applied |
| 20 | 366 | 61195158 | 61204000 | 8,842 | gain | 1541 | HAR1B, HAR1A | Y | 1 | 6 | 8.91 | Exon+ve, ASD > 4, Normals < 2, no Sanger filter applied |
| 20 | 366 | 61195158 | 61204000 | 8,842 | gain | 1542 | HAR1B, HAR1A | Y | 1 | 6 | 8.91 | Exon+ve, ASD > 4, Normals < 2, no Sanger filter applied |
| 20 | 366 | 61195158 | 61204000 | 8,842 | gain | 1591 | HAR1B, HAR1A | Y | 1 | 6 | 8.91 | Exon+ve, ASD > 4, Normals < 2, no Sanger filter applied |
| 20 | 366 | 61195158 | 61204000 | 8,842 | gain | 1699 | HAR1B, HAR1A | Y | 1 | 6 | 8.91 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 21 | 367 | 46559453 | 46599682 | 40,229 | gain | 1430 | C21orf58, PCNT | Y | 1 | 2 | 2.95 | Exon+ve, 5 > ASD > 1, Normals < 2, Sanger-ve |
| 21 | 367 | 46559453 | 46599682 | 40,229 | gain | 1730 | C21orf58, PCNT | Y | 1 | 2 | 2.95 | Exon+ve, 5 > ASD > 1, Normals < 2, Sanger-ve |
| 21 | 368 | 46657906 | 46674328 | 16,422 | gain | 1430 | PCNT | Y | 1 | 2 | 2.95 | Exon+ve, 5 > ASD > 1, Normals < 2, Sanger-ve |
| 21 | 368 | 46657906 | 46674328 | 16,422 | gain | 1953 | PCNT | Y | 1 | 2 | 2.95 | Exon+ve, 5 > ASD > 1, Normals < 2, Sanger-ve |
| 22 | 369 | 17403164 | 17431180 | 28,016 | gain | 1490 | DGCR11, DGCR2 | Y | 1 | 3 | 4.44 | Exon+ve, 5 > ASD > 1, Normals < 2, Sanger-ve |
| 22 | 369 | 17403164 | 17431180 | 28,016 | gain | 1753 | DGCR11, DGCR2 | Y | 1 | 3 | 4.44 | Exon+ve, 5 > ASD > 1, Normals < 2, Sanger-ve |
| 22 | 369 | 17403164 | 17431180 | 28,016 | gain | 1844 | DGCR11, DGCR2 | Y | 1 | 3 | 4.44 | Exon+ve, 5 > ASD > 1, Normals < 2, Sanger-ve |
| 22 | 370 | 17431181 | 17433410 | 2,229 | gain | 1490 | DGCR2 | Y | 1 | 6 | 8.91 | Exon+ve, ASD > 4, Normals < 2, no Sanger filter applied |
| 22 | 370 | 17431181 | 17433410 | 2,229 | loss | 1598 | DGCR2 | Y | 1 | 6 | 8.91 | Exon+ve, ASD > 4, Normals < 2, no Sanger filter applied |
| 22 | 370 | 17431181 | 17433410 | 2,229 | loss | 1623 | DGCR2 | Y | 1 | 6 | 8.91 | Exon+ve, ASD > 4, Normals < 2, no Sanger filter applied |
| 22 | 370 | 17431181 | 17433410 | 2,229 | loss | 1641 | DGCR2 | Y | 1 | 6 | 8.91 | Exon+ve, ASD > 4, Normals < 2, no Sanger filter applied |
| 22 | 370 | 17431181 | 17433410 | 2,229 | gain | 1753 | DGCR2 | Y | 1 | 6 | 8.91 | Exon+ve, ASD > 4, Normals < 2, no Sanger filter applied |
| 22 | 370 | 17431181 | 17433410 | 2,229 | gain | 1844 | DGCR2 | Y | 1 | 6 | 8.91 | Exon+ve, ASD > 4, Normals < 2, no Sanger filter applied |
| 22 | 371 | 17433411 | 17515293 | 81,882 | gain | 1490 | DGCR2, TSSK2, DGCR14 | Y | 1 | 3 | 4.44 | Exon+ve, 5 > ASD > 1, Normals < 2, Sanger-ve |
| 22 | 371 | 17433411 | 17515293 | 81,882 | gain | 1753 | DGCR2, TSSK2, DGCR14 | Y | 1 | 3 | 4.44 | Exon+ve, 5 > ASD > 1, Normals < 2, Sanger-ve |
| 22 | 371 | 17433411 | 17515293 | 81,882 | gain | 1844 | DGCR2, TSSK2, DGCR14 | Y | 1 | 3 | 4.44 | Exon+ve, 5 > ASD > 1, Normals < 2, Sanger-ve |
| 22 | 372 | 17516927 | 17572569 | 55,642 | gain | 1490 | CLTCL1, SLC25A1, GSC2 | Y | 1 | 3 | 4.44 | Exon+ve, 5 > ASD > 1, Normals < 2, Sanger-ve |
| 22 | 372 | 17516927 | 17572569 | 55,642 | gain | 1753 | CLTCL1, SLC25A1, GSC2 | Y | 1 | 3 | 4.44 | Exon+ve, 5 > ASD > 1, Normals < 2, Sanger-ve |
| 22 | 372 | 17516927 | 17572569 | 55,642 | gain | 1844 | CLTCL1, SLC25A1, GSC2 | Y | 1 | 3 | 4.44 | Exon+ve, 5 > ASD > 1, Normals < 2, Sanger-ve |
| 22 | 373 | 17574912 | 17652879 | 77,967 | gain | 1490 | CLTCL1 | Y | 1 | 3 | 4.44 | Exon+ve, 5 > ASD > 1, Normals < 2, Sanger-ve |
| 22 | 373 | 17574912 | 17652879 | 77,967 | gain | 1753 | CLTCL1 | Y | 1 | 3 | 4.44 | Exon+ve, 5 > ASD > 1, Normals < 2, Sanger-ve |
| 22 | 373 | 17574912 | 17652879 | 77,967 | gain | 1844 | CLTCL1 | Y | 1 | 3 | 4.44 | Exon+ve, 5 > ASD > 1, Normals < 2, Sanger-ve |
| 22 | 374 | 17662875 | 17941363 | 278,488 | gain | 1490 | HIRA, CLDN5, C22orf39, MRPL40, LOC150185, CDC45, UFD1L | Y | 1 | 3 | 4.44 | Exon+ve, 5 > ASD > 1, Normals < 2, Sanger-ve |
| 22 | 374 | 17662875 | 17941363 | 278,488 | gain | 1753 | HIRA, CLDN5, C22orf39, MRPL40, LOC150185, CDC45, UFD1L | Y | 1 | 3 | 4.44 | Exon+ve, 5 > ASD > 1, Normals < 2, Sanger-ve |
| 22 | 374 | 17662875 | 17941363 | 278,488 | gain | 1844 | HIRA, CLDN5, C22orf39, MRPL40, LOC150185, CDC45, UFD1L | Y | 1 | 3 | 4.44 | Exon+ve, 5 > ASD > 1, Normals < 2, Sanger-ve |
| 22 | 375 | 17957096 | 18092254 | 135,158 | gain | 1490 | SEPT5, GP1BB, SEPT5-GP1BB | Y | 1 | 3 | 4.44 | Exon+ve, 5 > ASD > 1, Normals < 2, Sanger-ve |
| 22 | 375 | 17957096 | 18092254 | 135,158 | gain | 1753 | SEPT5, GP1BB, SEPT5-GP1BB | Y | 1 | 3 | 4.44 | Exon+ve, 5 > ASD > 1, Normals < 2, Sanger-ve |
| 22 | 375 | 17957096 | 18092254 | 135,158 | gain | 1844 | SEPT5, GP1BB, SEPT5-GP1BB | Y | 1 | 3 | 4.44 | Exon+ve, 5 > ASD > 1, Normals < 2, Sanger-ve |
| 22 | 376 | 18092255 | 18093176 | 921 | gain | 1490 | GP1BB, SEPT5-GP1BB | Y | 1 | 5 | 7.42 | Exon+ve, ASD > 4, Normals < 2, no Sanger filter applied |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 22 | 376 | 18092255 | 18093176 | 921 | gain | 1753 | GP1BB, SEPT5-GP1BB | Y | 1 | 5 | 7.42 | Exon+ve, ASD > 4, Normals < 2, no Sanger filter applied |
| 22 | 376 | 18092255 | 18093176 | 921 | gain | 1780 | GP1BB, SEPT5-GP1BB | Y | 1 | 5 | 7.42 | Exon+ve, ASD > 4, no Sanger filter applied |
| 22 | 376 | 18092255 | 18093176 | 921 | gain | 1844 | GP1BB, SEPT5-GP1BB | Y | 1 | 5 | 7.42 | Exon+ve, ASD > 4, Normals < 2, no Sanger filter applied |
| 22 | 376 | 18092255 | 18093176 | 921 | loss | 2005 | GP1BB, SEPT5-GP1BB | Y | 1 | 5 | 7.42 | Exon+ve, ASD > 4, Normals < 2, no Sanger filter applied |
| 22 | 377 | 18123761 | 18125355 | 1,594 | gain | 1490 | TBX1 | Y | 1 | 4 | 5.92 | Exon+ve, 5 > ASD > 1, Normals < 2, Sanger-ve |
| 22 | 377 | 18123761 | 18125355 | 1,594 | gain | 1753 | TBX1 | Y | 1 | 4 | 5.92 | Exon+ve, 5 > ASD > 1, Normals < 2, Sanger-ve |
| 22 | 377 | 18123761 | 18125355 | 1,594 | gain | 1844 | TBX1 | Y | 1 | 4 | 5.92 | Exon+ve, 5 > ASD > 1, Normals < 2, Sanger-ve |
| 22 | 377 | 18123761 | 18125355 | 1,594 | loss | 2005 | TBX1 | Y | 1 | 4 | 5.92 | Exon+ve, 5 > ASD > 1, Normals < 2, Sanger-ve |
| 22 | 378 | 18131562 | 18140658 | 9,096 | gain | 1490 | TBX1 | Y | 1 | 3 | 4.44 | Exon+ve, 5 > ASD > 1, Normals < 2, Sanger-ve |
| 22 | 378 | 18131562 | 18140658 | 9,096 | gain | 1753 | TBX1 | Y | 1 | 3 | 4.44 | Exon+ve, 5 > ASD > 1, Normals < 2, Sanger-ve |
| 22 | 378 | 18131562 | 18140658 | 9,096 | gain | 1844 | TBX1 | Y | 1 | 3 | 4.44 | Exon+ve, 5 > ASD > 1, Normals < 2, Sanger-ve |
| 22 | 379 | 18142945 | 18166699 | 23,754 | gain | 1490 | GNB1L, TBX1 | Y | 1 | 3 | 4.44 | Exon+ve, 5 > ASD > 1, Normals < 2, Sanger-ve |
| 22 | 379 | 18142945 | 18166699 | 23,754 | gain | 1753 | GNB1L, TBX1 | Y | 1 | 3 | 4.44 | Exon+ve, 5 > ASD > 1, Normals < 2, Sanger-ve |
| 22 | 379 | 18142945 | 18166699 | 23,754 | gain | 1844 | GNB1L, TBX1 | Y | 1 | 3 | 4.44 | Exon+ve, 5 > ASD > 1, Normals < 2, Sanger-ve |
| 22 | 380 | 18173638 | 18409271 | 235,633 | gain | 1490 | ARVCF, MIR185, C22orf29, COMT, GNB1L, TXNRD2, C22orf25 | Y | 1 | 3 | 4.44 | Exon+ve, 5 > ASD > 1, Normals < 2, Sanger-ve |
| 22 | 380 | 18173638 | 18409271 | 235,633 | gain | 1753 | ARVCF, MIR185, C22orf29, COMT, GNB1L, TXNRD2, C22orf25 | Y | 1 | 3 | 4.44 | Exon+ve, 5 > ASD > 1, Normals < 2, Sanger-ve |
| 22 | 380 | 18173638 | 18409271 | 235,633 | gain | 1844 | ARVCF, MIR185, C22orf29, COMT, GNB1L, TXNRD2, C22orf25 | Y | 1 | 3 | 4.44 | Exon+ve, 5 > ASD > 1, Normals < 2, Sanger-ve |
| 22 | 381 | 18433173 | 18504518 | 71,345 | gain | 1490 | DGCR8, ZDHHC8, MIR3618, TRMT2A, MIR1306, RANBP1, C22orf25 | Y | 1 | 3 | 4.44 | Exon+ve, 5 > ASD > 1, Normals < 2, Sanger-ve |
| 22 | 381 | 18433173 | 18504518 | 71,345 | gain | 1753 | DGCR8, ZDHHC8, MIR3618, TRMT2A, MIR1306, RANBP1, C22orf25 | Y | 1 | 3 | 4.44 | Exon+ve, 5 > ASD > 1, Normals < 2, Sanger-ve |
| 22 | 381 | 18433173 | 18504518 | 71,345 | gain | 1844 | DGCR8, ZDHHC8, MIR3618, TRMT2A, MIR1306, RANBP1, C22orf25 | Y | 1 | 3 | 4.44 | Exon+ve, 5 > ASD > 1, Normals < 2, Sanger-ve |
| 22 | 382 | 18504519 | 18505512 | 993 | gain | 1490 | ZDHHC8 | N | 1 | 5 | 7.42 | Intron+ve, ASD > 4, Normals < 2, no Sanger filter applied |
| 22 | 382 | 18504519 | 18505512 | 993 | gain | 1753 | ZDHHC8 | N | 1 | 5 | 7.42 | Intron+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 22 | 382 | 18504519 | 18505512 | 993 | gain | 1844 | ZDHHC8 | N | 1 | 5 | 7.42 | Intron+ve, ASD > 4, Normals < 2, no Sanger filter applied |
| 22 | 382 | 18504519 | 18505512 | 993 | loss | 1963 | ZDHHC8 | N | 1 | 5 | 7.42 | Intron+ve, ASD > 4, Normals < 2, no Sanger filter applied |
| 22 | 382 | 18504519 | 18505512 | 993 | loss | 1968 | ZDHHC8 | N | 1 | 5 | 7.42 | Intron+ve, ASD > 4, Normals < 2, no Sanger filter applied |
| 22 | 383 | 18505513 | 18507464 | 1,951 | gain | 1490 | ZDHHC8 | Y | 1 | 8 | 11.92 | Exon+ve, ASD > 4, Normals < 2, no Sanger filter applied |
| 22 | 383 | 18505513 | 18507464 | 1,951 | loss | 1557 | ZDHHC8 | Y | 1 | 8 | 11.92 | Exon+ve, ASD > 4, Normals < 2, no Sanger filter applied |
| 22 | 383 | 18505513 | 18507464 | 1,951 | gain | 1753 | ZDHHC8 | Y | 1 | 8 | 11.92 | Exon+ve, ASD > 4, Normals < 2, no Sanger filter applied |
| 22 | 383 | 18505513 | 18507464 | 1,951 | gain | 1844 | ZDHHC8 | Y | 1 | 8 | 11.92 | Exon+ve, ASD > 4, Normals < 2, no Sanger filter applied |
| 22 | 383 | 18505513 | 18507464 | 1,951 | loss | 1963 | ZDHHC8 | Y | 1 | 8 | 11.92 | Exon+ve, ASD > 4, Normals < 2, no Sanger filter applied |
| 22 | 383 | 18505513 | 18507464 | 1,951 | loss | 1968 | ZDHHC8 | Y | 1 | 8 | 11.92 | Exon+ve, ASD > 4, Normals < 2, no Sanger filter applied |
| 22 | 383 | 18505513 | 18507464 | 1,951 | loss | 1991 | ZDHHC8 | Y | 1 | 8 | 11.92 | Exon+ve, ASD > 4, Normals < 2, no Sanger filter applied |
| 22 | 383 | 18505513 | 18507464 | 1,951 | loss | 1993 | ZDHHC8 | Y | 1 | 8 | 11.92 | Exon+ve, ASD > 4, Normals < 2, no Sanger filter applied |
| 22 | 384 | 18507465 | 18513604 | 6,139 | loss | 1314 | ZDHHC8 | Y | 1 | 12 | 17.98 | Exon+ve, ASD > 4, Normals < 2, no Sanger filter applied |
| 22 | 384 | 18507465 | 18513604 | 6,139 | gain | 1490 | ZDHHC8 | Y | 1 | 12 | 17.98 | Exon+ve, ASD > 4, Normals < 2, no Sanger filter applied |
| 22 | 384 | 18507465 | 18513604 | 6,139 | loss | 1557 | ZDHHC8 | Y | 1 | 12 | 17.98 | Exon+ve, ASD > 4, Normals < 2, no Sanger filter applied |
| 22 | 384 | 18507465 | 18513604 | 6,139 | gain | 1753 | ZDHHC8 | Y | 1 | 12 | 17.98 | Exon+ve, ASD > 4, Normals < 2, no Sanger filter applied |
| 22 | 384 | 18507465 | 18513604 | 6,139 | loss | 1833 | ZDHHC8 | Y | 1 | 12 | 17.98 | Exon+ve, ASD > 4, Normals < 2, no Sanger filter applied |
| 22 | 384 | 18507465 | 18513604 | 6,139 | gain | 1844 | ZDHHC8 | Y | 1 | 12 | 17.98 | Exon+ve, ASD > 4, Normals < 2, no Sanger filter applied |
| 22 | 384 | 18507465 | 18513604 | 6,139 | loss | 1859 | ZDHHC8 | Y | 1 | 12 | 17.98 | Exon+ve, ASD > 4, Normals < 2, no Sanger filter applied |
| 22 | 384 | 18507465 | 18513604 | 6,139 | loss | 1963 | ZDHHC8 | Y | 1 | 12 | 17.98 | Exon+ve, ASD > 4, Normals < 2, no Sanger filter applied |
| 22 | 384 | 18507465 | 18513604 | 6,139 | loss | 1968 | ZDHHC8 | Y | 1 | 12 | 17.98 | Exon+ve, ASD > 4, Normals < 2, no Sanger filter applied |
| 22 | 384 | 18507465 | 18513604 | 6,139 | loss | 1991 | ZDHHC8 | Y | 1 | 12 | 17.98 | Exon+ve, ASD > 4, Normals < 2, no Sanger filter applied |
| 22 | 384 | 18507465 | 18513604 | 6,139 | loss | 1993 | ZDHHC8 | Y | 1 | 12 | 17.98 | Exon+ve, ASD > 4, Normals < 2, no Sanger filter applied |
| 22 | 384 | 18507465 | 18513604 | 6,139 | loss | 2043 | ZDHHC8 | Y | 1 | 12 | 17.98 | Exon+ve, ASD > 4, Normals < 2, no Sanger filter applied |
| 22 | 385 | 18513616 | 18519020 | 5,404 | gain | 1490 | ZDHHC8 | Y | 1 | 4 | 5.92 | Exon+ve, 5 > ASD > 1, Normals < 2, Sanger-ve |
| 22 | 385 | 18513616 | 18519020 | 5,404 | gain | 1753 | ZDHHC8 | Y | 1 | 4 | 5.92 | Exon+ve, 5 > ASD > 1, Normals < 2, Sanger-ve |
| 22 | 385 | 18513616 | 18519020 | 5,404 | gain | 1844 | ZDHHC8 | Y | 1 | 4 | 5.92 | Exon+ve, 5 > ASD > 1, Normals < 2, Sanger-ve |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 22 | 385 | 18513616 | 18519020 | 5,404 | loss | 1991 | ZDHHC8 | Y | 1 | 4 | 5.92 | Exon+ve, 5 > ASD > 1, Normals < 2, Sanger-ve |
| 22 | 386 | 19459699 | 19475462 | 15,763 | gain | 1490 | SERPIND1, PI4KA | Y | 1 | 3 | 4.44 | Exon+ve, 5 > ASD > 1, Normals < 2, Sanger-ve |
| 22 | 386 | 19459699 | 19475462 | 15,763 | gain | 1753 | SERPIND1, PI4KA | Y | 1 | 3 | 4.44 | Exon+ve, 5 > ASD > 1, Normals < 2, Sanger-ve |
| 22 | 386 | 19459699 | 19475462 | 15,763 | gain | 1844 | SERPIND1, PI4KA | Y | 1 | 3 | 4.44 | Exon+ve, 5 > ASD > 1, Normals < 2, Sanger-ve |
| 22 | 387 | 19476441 | 19607267 | 130,826 | gain | 1490 | CRKL, SNAP29, PI4KA | Y | 1 | 3 | 4.44 | Exon+ve, 5 > ASD > 1, Normals < 2, Sanger-ve |
| 22 | 387 | 19476441 | 19607267 | 130,826 | gain | 1753 | CRKL, SNAP29, PI4KA | Y | 1 | 3 | 4.44 | Exon+ve, 5 > ASD > 1, Normals < 2, Sanger-ve |
| 22 | 387 | 19476441 | 19607267 | 130,826 | gain | 1844 | CRKL, SNAP29, PI4KA | Y | 1 | 3 | 4.44 | Exon+ve, 5 > ASD > 1, Normals < 2, Sanger-ve |
| 22 | 388 | 19615302 | 19616903 | 1,601 | gain | 1242 | CRKL | N | 1 | 6 | 8.91 | Intron+ve, ASD > 4, Normals < 2, no Sanger filter applied |
| 22 | 388 | 19615302 | 19616903 | 1,601 | gain | 1490 | CRKL | N | 1 | 6 | 8.91 | Intron+ve, ASD > 4, Normals < 2, no Sanger filter applied |
| 22 | 388 | 19615302 | 19616903 | 1,601 | loss | 1633 | CRKL | N | 1 | 6 | 8.91 | Intron+ve, ASD > 4, Normals < 2, no Sanger filter applied |
| 22 | 388 | 19615302 | 19616903 | 1,601 | gain | 1717 | CRKL | N | 1 | 6 | 8.91 | Intron+ve, ASD > 4, Normals < 2, no Sanger filter applied |
| 22 | 388 | 19615302 | 19616903 | 1,601 | gain | 1753 | CRKL | N | 1 | 6 | 8.91 | Intron+ve, ASD > 4, Normals < 2, no Sanger filter applied |
| 22 | 388 | 19615302 | 19616903 | 1,601 | gain | 1844 | CRKL | N | 1 | 6 | 8.91 | Intron+ve, ASD > 4, Normals < 2, no Sanger filter applied |
| 22 | 389 | 19616904 | 19620943 | 4,039 | gain | 1242 | CRKL | Y | 1 | 4 | 5.92 | Exon+ve, 5 > ASD > 1, Normals < 2, Sanger-ve |
| 22 | 389 | 19616904 | 19620943 | 4,039 | gain | 1490 | CRKL | Y | 1 | 4 | 5.92 | Exon+ve, 5 > ASD > 1, Normals < 2, Sanger-ve |
| 22 | 389 | 19616904 | 19620943 | 4,039 | gain | 1753 | CRKL | Y | 1 | 4 | 5.92 | Exon+ve, 5 > ASD > 1, Normals < 2, Sanger-ve |
| 22 | 389 | 19616904 | 19620943 | 4,039 | gain | 1844 | CRKL | Y | 1 | 4 | 5.92 | Exon+ve, 5 > ASD > 1, Normals < 2, Sanger-ve |
| 22 | 390 | 22618050 | 22643741 | 25,691 | loss | 1263 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1278 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1282 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1468 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1489 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1564 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1568 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1573 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1602 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1618 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1671 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1716 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1742 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1819 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1833 | DDTL, GSTT2B, GSTT2, DDT | Y | 6 | 16 | 8.2 | Genic (distinct CNV-subregions); OR > 6 |
| 22 | 390 | 22618050 | 22643741 | 25,691 | loss | 1851 | DDTL, GSTT2B, GSTT2, DDT | Y | 6 | 16 | 8.2 | Genic (distinct CNV-subregions); OR > 6 |
| 22 | 391 | 22643742 | 22644242 | 500 | loss | 1263 | DDTL, DDT | Y | 6 | 18 | 8.2 | Genic (distinct CNV-subregions); OR > 6 |

TABLE 2-continued

| Chr | CNV Subregion Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 22 | 391 | 22643742 | 22644242 | 500 | loss | 1278 | DDTL, DDT | Y | 6 | 18 | 8.2 | Genic (distinct CNV-subregions); OR > 6 |
| 22 | 391 | 22643742 | 22644242 | 500 | loss | 1282 | DDTL, DDT | Y | 6 | 18 | 8.2 | Genic (distinct CNV-subregions); OR > 6 |
| 22 | 391 | 22643742 | 22644242 | 500 | loss | 1468 | DDTL, DDT | Y | 6 | 18 | 8.2 | Genic (distinct CNV-subregions); OR > 6 |
| 22 | 391 | 22643742 | 22644242 | 500 | loss | 1489 | DDTL, DDT | Y | 6 | 18 | 8.2 | Genic (distinct CNV-subregions); OR > 6 |
| 22 | 391 | 22643742 | 22644242 | 500 | loss | 1564 | DDTL, DDT | Y | 6 | 18 | 8.2 | Genic (distinct CNV-subregions); OR > 6 |
| 22 | 391 | 22643742 | 22644242 | 500 | loss | 1568 | DDTL, DDT | Y | 6 | 18 | 8.2 | Genic (distinct CNV-subregions); OR > 6 |
| 22 | 391 | 22643742 | 22644242 | 500 | loss | 1573 | DDTL, DDT | Y | 6 | 18 | 8.2 | Genic (distinct CNV-subregions); OR > 6 |
| 22 | 391 | 22643742 | 22644242 | 500 | loss | 1602 | DDTL, DDT | Y | 6 | 18 | 8.2 | Genic (distinct CNV-subregions); OR > 6 |
| 22 | 391 | 22643742 | 22644242 | 500 | loss | 1606 | DDTL, DDT | Y | 6 | 18 | 8.2 | Genic (distinct CNV-subregions); OR > 6 |
| 22 | 391 | 22643742 | 22644242 | 500 | loss | 1618 | DDTL, DDT | Y | 6 | 18 | 8.2 | Genic (distinct CNV-subregions); OR > 6 |
| 22 | 391 | 22643742 | 22644242 | 500 | loss | 1671 | DDTL, DDT | Y | 6 | 18 | 8.2 | Genic (distinct CNV-subregions); OR > 6 |
| 22 | 391 | 22643742 | 22644242 | 500 | loss | 1716 | DDTL, DDT | Y | 6 | 18 | 8.2 | Genic (distinct CNV-subregions); OR > 6 |
| 22 | 391 | 22643742 | 22644242 | 500 | loss | 1741 | DDTL, DDT | Y | 6 | 18 | 8.2 | Genic (distinct CNV-subregions); OR > 6 |
| 22 | 391 | 22643742 | 22644242 | 500 | loss | 1742 | DDTL, DDT | Y | 6 | 18 | 8.2 | Genic (distinct CNV-subregions); OR > 6 |
| 22 | 391 | 22643742 | 22644242 | 500 | loss | 1819 | DDTL, DDT | Y | 6 | 18 | 8.2 | Genic (distinct CNV-subregions); OR > 6 |
| 22 | 391 | 22643742 | 22644242 | 500 | loss | 1833 | DDTL, DDT | Y | 6 | 18 | 8.2 | Genic (distinct CNV-subregions); OR > 6 |
| 22 | 391 | 22643742 | 22644242 | 500 | loss | 1851 | DDTL, DDT | Y | 6 | 18 | 8.2 | Genic (distinct CNV-subregions); OR > 6 |
| 22 | 392 | 22644243 | 22667607 | 23,364 | loss | 1232 | DDTL, GSTT2, DDT | Y | 6 | 32 | 8.2 | Genic (distinct CNV-subregions); OR > 6 |
| 22 | 392 | 22644243 | 22667607 | 23,364 | loss | 1263 | DDTL, GSTT2, DDT | Y | 6 | 32 | 8.2 | Genic (distinct CNV-subregions); OR > 6 |
| 22 | 392 | 22644243 | 22667607 | 23,364 | loss | 1268 | DDTL, GSTT2, DDT | Y | 6 | 32 | 8.2 | Genic (distinct CNV-subregions); OR > 6 |
| 22 | 392 | 22644243 | 22667607 | 23,364 | loss | 1278 | DDTL, GSTT2, DDT | Y | 6 | 32 | 8.2 | Genic (distinct CNV-subregions); OR > 6 |
| 22 | 392 | 22644243 | 22667607 | 23,364 | loss | 1282 | DDTL, GSTT2, DDT | Y | 6 | 32 | 8.2 | Genic (distinct CNV-subregions); OR > 6 |
| 22 | 392 | 22644243 | 22667607 | 23,364 | loss | 1468 | DDTL, GSTT2, DDT | Y | 6 | 32 | 8.2 | Genic (distinct CNV-subregions); OR > 6 |
| 22 | 392 | 22644243 | 22667607 | 23,364 | loss | 1489 | DDTL, GSTT2, DDT | Y | 6 | 32 | 8.2 | Genic (distinct CNV-subregions); OR > 6 |
| 22 | 392 | 22644243 | 22667607 | 23,364 | loss | 1496 | DDTL, GSTT2, DDT | Y | 6 | 32 | 8.2 | Genic (distinct CNV-subregions); OR > 6 |
| 22 | 392 | 22644243 | 22667607 | 23,364 | loss | 1533 | DDTL, GSTT2, DDT | Y | 6 | 32 | 8.2 | Genic (distinct CNV-subregions); OR > 6 |
| 22 | 392 | 22644243 | 22667607 | 23,364 | loss | 1534 | DDTL, GSTT2, DDT | Y | 6 | 32 | 8.2 | Genic (distinct CNV-subregions); OR > 6 |
| 22 | 392 | 22644243 | 22667607 | 23,364 | loss | 1564 | DDTL, GSTT2, DDT | Y | 6 | 32 | 8.2 | Genic (distinct CNV-subregions); OR > 6 |
| 22 | 392 | 22644243 | 22667607 | 23,364 | loss | 1568 | DDTL, GSTT2, DDT | Y | 6 | 32 | 8.2 | Genic (distinct CNV-subregions); OR > 6 |
| 22 | 392 | 22644243 | 22667607 | 23,364 | loss | 1573 | DDTL, GSTT2, DDT | Y | 6 | 32 | 8.2 | Genic (distinct CNV-subregions); OR > 6 |
| 22 | 392 | 22644243 | 22667607 | 23,364 | loss | 1602 | DDTL, GSTT2, DDT | Y | 6 | 32 | 8.2 | Genic (distinct CNV-subregions); OR > 6 |
| 22 | 392 | 22644243 | 22667607 | 23,364 | loss | 1606 | DDTL, GSTT2, DDT | Y | 6 | 32 | 8.2 | Genic (distinct CNV-subregions); OR > 6 |
| 22 | 392 | 22644243 | 22667607 | 23,364 | loss | 1618 | DDTL, GSTT2, DDT | Y | 6 | 32 | 8.2 | Genic (distinct CNV-subregions); OR > 6 |
| 22 | 392 | 22644243 | 22667607 | 23,364 | loss | 1656 | DDTL, GSTT2, DDT | Y | 6 | 32 | 8.2 | Genic (distinct CNV-subregions); OR > 6 |
| 22 | 392 | 22644243 | 22667607 | 23,364 | loss | 1667 | DDTL, GSTT2, DDT | Y | 6 | 32 | 8.2 | Genic (distinct CNV-subregions); OR > 6 |
| 22 | 392 | 22644243 | 22667607 | 23,364 | loss | 1669 | DDTL, GSTT2, DDT | Y | 6 | 32 | 8.2 | Genic (distinct CNV-subregions); OR > 6 |
| 22 | 392 | 22644243 | 22667607 | 23,364 | loss | 1671 | DDTL, GSTT2, DDT | Y | 6 | 32 | 8.2 | Genic (distinct CNV-subregions); OR > 6 |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 22 | 392 | 22644243 | 22667607 | 23,364 | loss | 1716 | DDTL, GSTT2, DDT | Y | 6 | 32 | 8.2 | Genic (distinct CNV-subregions); OR > 6 |
| 22 | 392 | 22644243 | 22667607 | 23,364 | loss | 1720 | DDTL, GSTT2, DDT | Y | 6 | 32 | 8.2 | Genic (distinct CNV-subregions); OR > 6 |
| 22 | 392 | 22644243 | 22667607 | 23,364 | loss | 1729 | DDTL, GSTT2, DDT | Y | 6 | 32 | 8.2 | Genic (distinct CNV-subregions); OR > 6 |
| 22 | 392 | 22644243 | 22667607 | 23,364 | loss | 1741 | DDTL, GSTT2, DDT | Y | 6 | 32 | 8.2 | Genic (distinct CNV-subregions); OR > 6 |
| 22 | 392 | 22644243 | 22667607 | 23,364 | loss | 1742 | DDTL, GSTT2, DDT | Y | 6 | 32 | 8.2 | Genic (distinct CNV-subregions); OR > 6 |
| 22 | 392 | 22644243 | 22667607 | 23,364 | loss | 1809 | DDTL, GSTT2, DDT | Y | 6 | 32 | 8.2 | Genic (distinct CNV-subregions); OR > 6 |
| 22 | 392 | 22644243 | 22667607 | 23,364 | loss | 1819 | DDTL, GSTT2, DDT | Y | 6 | 32 | 8.2 | Genic (distinct CNV-subregions); OR > 6 |
| 22 | 392 | 22644243 | 22667607 | 23,364 | loss | 1833 | DDTL, GSTT2, DDT | Y | 6 | 32 | 8.2 | Genic (distinct CNV-subregions); OR > 6 |
| 22 | 392 | 22644243 | 22667607 | 23,364 | loss | 1851 | DDTL, GSTT2, DDT | Y | 6 | 32 | 8.2 | Genic (distinct CNV-subregions); OR > 6 |
| 22 | 392 | 22644243 | 22667607 | 23,364 | loss | 1868 | DDTL, GSTT2, DDT | Y | 6 | 32 | 8.2 | Genic (distinct CNV-subregions); OR > 6 |
| 22 | 392 | 22644243 | 22667607 | 23,364 | loss | 2037 | DDTL, GSTT2, DDT | Y | 6 | 32 | 8.2 | Genic (distinct CNV-subregions); OR > 6 |
| 22 | 392 | 22644243 | 22667607 | 23,364 | loss | 2040 | DDTL, GSTT2, DDT | Y | 6 | 32 | 8.2 | Genic (distinct CNV-subregions); OR > 6 |
| 22 | 393 | 22725306 | 22735036 | 9,730 | loss | 1282 | GSTTP2 | Y | 0 | 7 | 10.41 | Exon+ve, ASD > 4, Normals < 2, no Sanger filter applied |
| 22 | 393 | 22725306 | 22735036 | 9,730 | loss | 1345 | GSTTP2 | Y | 0 | 7 | 10.41 | Exon+ve, ASD > 4, Normals < 2, no Sanger filter applied |
| 22 | 393 | 22725306 | 22735036 | 9,730 | gain | 1412 | GSTTP2 | Y | 0 | 7 | 10.41 | Exon+ve, ASD > 4, Normals < 2, no Sanger filter applied |
| 22 | 393 | 22725306 | 22735036 | 9,730 | gain | 1449 | GSTTP2 | Y | 0 | 7 | 10.41 | Exon+ve, ASD > 4, Normals < 2, no Sanger filter applied |
| 22 | 393 | 22725306 | 22735036 | 9,730 | loss | 1618 | GSTTP2 | Y | 0 | 7 | 10.41 | Exon+ve, ASD > 4, Normals < 2, no Sanger filter applied |
| 22 | 393 | 22725306 | 22735036 | 9,730 | loss | 1639 | GSTTP2 | Y | 0 | 7 | 10.41 | Exon+ve, ASD > 4, Normals < 2, no Sanger filter applied |
| 22 | 393 | 22725306 | 22735036 | 9,730 | loss | 1792 | GSTTP2 | Y | 0 | 7 | 10.41 | Exon+ve, ASD > 4, Normals < 2, no Sanger filter applied |
| 22 | 394 | 28479825 | 28481680 | 1,855 | gain | 1468 | ZMAT5 | Y | 1 | 2 | 2.95 | Exon+ve, 5 > ASD > 1, Normals < 2, Sanger−ve |
| 22 | 394 | 28479825 | 28481680 | 1,855 | gain | 1581 | ZMAT5 | Y | 1 | 2 | 2.95 | Exon+ve, 5 > ASD > 1, Normals < 2, Sanger−ve |
| 22 | 395 | 34122937 | 34129032 | 6,095 | loss | 1432 | MCM5 | Y | 1 | 5 | 7.42 | Exon+ve, ASD > 4, Normals < 2, no Sanger filter applied |
| 22 | 395 | 34122937 | 34129032 | 6,095 | loss | 1438 | MCM5 | Y | 1 | 5 | 7.42 | Exon+ve, ASD > 4, Normals < 2, no Sanger filter applied |
| 22 | 395 | 34122937 | 34129032 | 6,095 | loss | 1823 | MCM5 | Y | 1 | 5 | 7.42 | Exon+ve, ASD > 4, Normals < 2, no Sanger filter applied |
| 22 | 395 | 34122937 | 34129032 | 6,095 | loss | 1875 | MCM5 | Y | 1 | 5 | 7.42 | Exon+ve, ASD > 4, Normals < 2, no Sanger filter applied |
| 22 | 395 | 34122937 | 34129032 | 6,095 | loss | 1908 | MCM5 | Y | 1 | 5 | 7.42 | Exon+ve, ASD > 4, Normals < 2, no Sanger filter applied |
| 22 | 396 | 34129033 | 34130625 | 1,592 | loss | 1432 | MCM5 | Y | 1 | 6 | 8.91 | Exon+ve, ASD > 4, Normals < 2, no Sanger filter applied |
| 22 | 396 | 34129033 | 34130625 | 1,592 | loss | 1438 | MCM5 | Y | 1 | 6 | 8.91 | Exon+ve, ASD > 4, Normals < 2, no Sanger filter applied |
| 22 | 396 | 34129033 | 34130625 | 1,592 | loss | 1823 | MCM5 | Y | 1 | 6 | 8.91 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 22 | 396 | 34129033 | 34130625 | 1,592 | loss | 1875 | MCM5 | Y | 1 | 6 | 8.91 | Exon+ve, ASD > 4, Normals < 2, no Sanger filter applied |
| 22 | 396 | 34129033 | 34130625 | 1,592 | loss | 1908 | MCM5 | Y | 1 | 6 | 8.91 | Exon+ve, ASD > 4, Normals < 2, no Sanger filter applied |
| 22 | 396 | 34129033 | 34130625 | 1,592 | loss | 2031 | MCM5 | Y | 1 | 6 | 8.91 | Exon+ve, ASD > 4, Normals < 2, no Sanger filter applied |
| 22 | 397 | 34130626 | 34132976 | 2,350 | loss | 1432 | MCM5 | Y | 1 | 5 | 7.42 | Exon+ve, ASD > 4, Normals < 2, no Sanger filter applied |
| 22 | 397 | 34130626 | 34132976 | 2,350 | loss | 1438 | MCM5 | Y | 1 | 5 | 7.42 | Exon+ve, ASD > 4, Normals < 2, no Sanger filter applied |
| 22 | 397 | 34130626 | 34132976 | 2,350 | loss | 1823 | MCM5 | Y | 1 | 5 | 7.42 | Exon+ve, ASD > 4, Normals < 2, no Sanger filter applied |
| 22 | 397 | 34130626 | 34132976 | 2,350 | loss | 1875 | MCM5 | Y | 1 | 5 | 7.42 | Exon+ve, ASD > 4, Normals < 2, no Sanger filter applied |
| 22 | 397 | 34130626 | 34132976 | 2,350 | loss | 1908 | MCM5 | Y | 1 | 5 | 7.42 | Exon+ve, ASD > 4, Normals < 2, no Sanger filter applied |
| 22 | 398 | 37685496 | 37689057 | 3,561 | loss | 1252 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1277 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1309 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1314 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1333 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1389 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1391 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1395 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1396 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1463 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1465 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1614 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1617 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1618 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1635 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1660 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1664 | APOBEC3A | Y | 0 | 32 | 49.43 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 22 | 398 | 37685496 | 37689057 | 3,561 | loss | 1683 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1697 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1740 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1743 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1765 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1767 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1769 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1774 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1778 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1783 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1830 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1842 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1867 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 1920 | APOBEC3A | Y | 0 | 32 | 49.43 | Exon+ve, ASD > 4, Normals < 2, no Sanger filter applied |
| 22 | 398 | 37685496 | 37689057 | 3,561 | loss | 2020 | APOBEC3A | Y | 0 | 32 | 49.43 | Exon+ve, ASD > 4, Normals < 2, no Sanger filter applied |
| 23 | 399 | 2740069 | 2742851 | 2,782 | gain | 1337 | XG | Y | 1 | 6 | 8.91 | Exon+ve, ASD > 4, Normals < 2, no Sanger filter applied |
| 23 | 399 | 2740069 | 2742851 | 2,782 | gain | 1434 | XG | Y | 1 | 6 | 8.91 | Exon+ve, ASD > 4, Normals < 2, no Sanger filter applied |
| 23 | 399 | 2740069 | 2742851 | 2,782 | gain | 1509 | XG | Y | 1 | 6 | 8.91 | Exon+ve, ASD > 4, Normals < 2, no Sanger filter applied |
| 23 | 399 | 2740069 | 2742851 | 2,782 | gain | 1732 | XG | Y | 1 | 6 | 8.91 | Exon+ve, ASD > 4, Normals < 2, no Sanger filter applied |
| 23 | 399 | 2740069 | 2742851 | 2,782 | gain | 1825 | XG | Y | 1 | 6 | 8.91 | Exon+ve, ASD > 4, Normals < 2, no Sanger filter applied |
| 23 | 399 | 2740069 | 2742851 | 2,782 | gain | 1917 | XG | Y | 1 | 6 | 8.91 | Exon+ve, ASD > 4, Normals < 2, no Sanger filter applied |
| 23 | 400 | 2743951 | 2747802 | 3,851 | gain | 1337 | XG | Y | 1 | 6 | 8.91 | Exon+ve, ASD > 4, Normals < 2, no Sanger filter applied |
| 23 | 400 | 2743951 | 2747802 | 3,851 | gain | 1434 | XG | Y | 1 | 6 | 8.91 | Exon+ve, ASD > 4, Normals < 2, no Sanger filter applied |
| 23 | 400 | 2743951 | 2747802 | 3,851 | gain | 1509 | XG | Y | 1 | 6 | 8.91 | Exon+ve, ASD > 4, Normals < 2, no Sanger filter applied |
| 23 | 400 | 2743951 | 2747802 | 3,851 | gain | 1732 | XG | Y | 1 | 6 | 8.91 | Exon+ve, ASD > 4, Normals < 2, no Sanger filter applied |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 23 | 400 | 2743951 | 2747802 | 3,851 | gain | 1825 | XG | Y | 1 | 6 | 8.91 | Exon+ve, ASD > 4, Normals < 2, no Sanger filter applied |
| 23 | 400 | 2743951 | 2747802 | 3,851 | gain | 1917 | XG | Y | 1 | 6 | 8.91 | Exon+ve, ASD > 4, Normals < 2, no Sanger filter applied |
| 23 | 401 | 2965671 | 3071668 | 105,997 | gain | 1337 | ARSF | Y | 1 | 2 | 2.95 | Exon+ve, 5 > ASD > 1, Normals < 2, Sanger-ve |
| 23 | 401 | 2965671 | 3071668 | 105,997 | gain | 1917 | ARSF | Y | 1 | 2 | 2.95 | Exon+ve, 5 > ASD > 1, Normals < 2, Sanger-ve |
| 23 | 402 | 6156507 | 6407401 | 250,894 | gain | 1337 | NLGN4X | Y | 1 | 2 | 2.95 | Exon+ve, 5 > ASD > 1, Normals < 2, Sanger-ve |
| 23 | 402 | 6156507 | 6407401 | 250,894 | gain | 1570 | NLGN4X | Y | 1 | 2 | 2.95 | Exon+ve, 5 > ASD > 1, Normals < 2, Sanger-ve |
| 23 | 403 | 15576976 | 15628244 | 51,268 | gain | 1337 | CA5BP1, TMEM27 | Y | 1 | 2 | 2.95 | Exon+ve, 5 > ASD > 1, Normals < 2, Sanger-ve |
| 23 | 403 | 15576976 | 15628244 | 51,268 | loss | 1413 | CA5BP1, TMEM27 | Y | 1 | 2 | 2.95 | Exon+ve, 5 > ASD > 1, Normals < 2, Sanger-ve |
| 23 | 404 | 22924046 | 23003050 | 79,004 | gain | 1337 | DDX53 | Y | 1 | 2 | 2.95 | Exon+ve, 5 > ASD > 1, Normals < 2, Sanger-ve |
| 23 | 404 | 22924046 | 23003050 | 79,004 | loss | 1811 | DDX53 | Y | 1 | 2 | 2.95 | Exon+ve, 5 > ASD > 1, Normals < 2, Sanger-ve |
| 23 | 405 | 23760270 | 23761632 | 1,362 | gain | 1337 | APOO | Y | 1 | 2 | 2.95 | Exon+ve, 5 > ASD > 1, Normals < 2, Sanger-ve |
| 23 | 405 | 23760270 | 23761632 | 1,362 | gain | 1527 | APOO | Y | 1 | 2 | 2.95 | Exon+ve, 5 > ASD > 1, Normals < 2, Sanger-ve |
| 23 | 406 | 23761633 | 23778330 | 16,697 | gain | 1337 | APOO | Y | 1 | 3 | 4.44 | Exon+ve, 5 > ASD > 1, Normals < 2, Sanger-ve |
| 23 | 406 | 23761633 | 23778330 | 16,697 | gain | 1527 | APOO | Y | 1 | 3 | 4.44 | Exon+ve, 5 > ASD > 1, Normals < 2, Sanger-ve |
| 23 | 406 | 23761633 | 23778330 | 16,697 | gain | 1619 | APOO | Y | 1 | 3 | 4.44 | Exon+ve, 5 > ASD > 1, Normals < 2, Sanger-ve |
| 23 | 407 | 31793198 | 31823142 | 29,944 | gain | 1337 | DMD | Y | 1 | 2 | 2.95 | Exon+ve, 5 > ASD > 1, Normals < 2, Sanger-ve |
| 23 | 407 | 31793198 | 31823142 | 29,944 | loss | 1862 | DMD | Y | 1 | 2 | 2.95 | Exon+ve, 5 > ASD > 1, Normals < 2, Sanger-ve |
| 23 | 408 | 37200683 | 37201899 | 1,216 | gain | 1337 | PRRG1 | Y | 1 | 3 | 4.44 | Exon+ve, 5 > ASD > 1, Normals < 2, Sanger-ve |
| 23 | 408 | 37200683 | 37201899 | 1,216 | gain | 2020 | PRRG1 | Y | 1 | 3 | 4.44 | Exon+ve, 5 > ASD > 1, Normals < 2, Sanger-ve |
| 23 | 408 | 37200683 | 37201899 | 1,216 | gain | 2031 | PRRG1 | Y | 1 | 3 | 4.44 | Exon+ve, 5 > ASD > 1, Normals < 2, Sanger-ve |
| 23 | 409 | 37674337 | 37775408 | 101,071 | gain | 1337 | SYTL5, CXorf27 | Y | 1 | 2 | 2.95 | Exon+ve, 5 > ASD > 1, Normals < 2, Sanger-ve |
| 23 | 409 | 37674337 | 37775408 | 101,071 | gain | 1649 | SYTL5, CXorf27 | Y | 1 | 2 | 2.95 | Exon+ve, 5 > ASD > 1, Normals < 2, Sanger-ve |
| 23 | 410 | 46248133 | 46295089 | 46,956 | gain | 1337 | ZNF674, LOC401588 | Y | 1 | 2 | 2.95 | Exon+ve, 5 > ASD > 1, Normals < 2, Sanger-ve |
| 23 | 410 | 46248133 | 46295089 | 46,956 | gain | 1874 | ZNF674, LOC401588 | Y | 1 | 2 | 2.95 | Exon+ve, 5 > ASD > 1, Normals < 2, Sanger-ve |
| 23 | 411 | 48514030 | 48520825 | 6,795 | gain | 1337 | GLOD5 | Y | 1 | 2 | 2.95 | Exon+ve, 5 > ASD > 1, Normals < 2, Sanger-ve |
| 23 | 411 | 48514030 | 48520825 | 6,795 | gain | 1349 | GLOD5 | Y | 1 | 2 | 2.95 | Exon+ve, 5 > ASD > 1, Normals < 2, Sanger-ve |
| 23 | 412 | 51038044 | 51341682 | 303,638 | gain | 1337 | NUDT10, NUDT11 | Y | 1 | 2 | 2.95 | Exon+ve, 5 > ASD > 1, Normals < 2, Sanger-ve |
| 23 | 412 | 51038044 | 51341682 | 303,638 | gain | 1349 | NUDT10, NUDT11 | Y | 1 | 2 | 2.95 | Exon+ve, 5 > ASD > 1, Normals < 2, Sanger-ve |
| 23 | 413 | 51379409 | 51453406 | 73,997 | gain | 1337 | LOC441495, CENPVL1 | Y | 1 | 2 | 2.95 | Exon+ve, 5 > ASD > 1, Normals < 2, Sanger-ve |
| 23 | 413 | 51379409 | 51453406 | 73,997 | gain | 1349 | LOC441495, CENPVL1 | Y | 1 | 2 | 2.95 | Exon+ve, 5 > ASD > 1, Normals < 2, Sanger-ve |
| 23 | 414 | 62435471 | 62610451 | 174,980 | gain | 1337 | SPIN4, LOC92249 | Y | 1 | 2 | 2.95 | Exon+ve, 5 > ASD > 1, Normals < 2, Sanger-ve |
| 23 | 414 | 62435471 | 62610451 | 174,980 | gain | 1646 | SPIN4, LOC92249 | Y | 1 | 2 | 2.95 | Exon+ve, 5 > ASD > 1, Normals < 2, Sanger-ve |
| 23 | 415 | 65684935 | 65848643 | 163,708 | gain | 1255 | EDA2R | Y | 1 | 4 | 5.92 | Exon+ve, 5 > ASD > 1, Normals < 2, Sanger-ve |
| 23 | 415 | 65684935 | 65848643 | 163,708 | gain | 1337 | EDA2R | Y | 1 | 4 | 5.92 | Exon+ve, 5 > ASD > 1, Normals < 2, Sanger-ve |
| 23 | 415 | 65684935 | 65848643 | 163,708 | gain | 1438 | EDA2R | Y | 1 | 4 | 5.92 | Exon+ve, 5 > ASD > 1, Normals < 2, Sanger-ve |
| 23 | 415 | 65684935 | 65848643 | 163,708 | loss | 1692 | EDA2R | Y | 1 | 4 | 5.92 | Exon+ve, 5 > ASD > 1, Normals < 2, Sanger-ve |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 23 | 416 | 73083877 | 73086192 | 2,315 | gain | 1337 | NCRNA00183 | Y | 1 | 5 | 7.42 | Intron+ve, ASD > 4, Normals < 2, no Sanger filter applied |
| 23 | 416 | 73083877 | 73086192 | 2,315 | loss | 1345 | NCRNA00183 | Y | 1 | 5 | 7.42 | Intron+ve, ASD > 4, Normals < 2, no Sanger filter applied |
| 23 | 416 | 73083877 | 73086192 | 2,315 | loss | 1493 | NCRNA00183 | Y | 1 | 5 | 7.42 | Intron+ve, ASD > 4, Normals < 2, no Sanger filter applied |
| 23 | 416 | 73083877 | 73086192 | 2,315 | loss | 1574 | NCRNA00183 | Y | 1 | 5 | 7.42 | Intron+ve, ASD > 4, Normals < 2, no Sanger filter applied |
| 23 | 416 | 73083877 | 73086192 | 2,315 | loss | 1856 | NCRNA00183 | Y | 1 | 5 | 7.42 | Intron+ve, ASD > 4, Normals < 2, no Sanger filter applied |
| 23 | 417 | 76992219 | 76998609 | 6,390 | gain | 1273 | MAGT1 | Y | 1 | 4 | 5.92 | Exon+ve, 5 > ASD > 1, Normals < 2, Sanger−ve |
| 23 | 417 | 76992219 | 76998609 | 6,390 | gain | 1337 | MAGT1 | Y | 1 | 4 | 5.92 | Exon+ve, 5 > ASD > 1, Normals < 2, Sanger−ve |
| 23 | 417 | 76992219 | 76998609 | 6,390 | gain | 1421 | MAGT1 | Y | 1 | 4 | 5.92 | Exon+ve, 5 > ASD > 1, Normals < 2, Sanger−ve |
| 23 | 417 | 76992219 | 76998609 | 6,390 | gain | 1864 | MAGT1 | Y | 1 | 4 | 5.92 | Exon+ve, 5 > ASD > 1, Normals < 2, Sanger−ve |
| 23 | 418 | 100409973 | 100414721 | 4,748 | gain | 1337 | TAF7L | Y | 1 | 2 | 2.95 | Exon+ve, 5 > ASD > 1, Normals < 2, Sanger−ve |
| 23 | 418 | 100409973 | 100414721 | 4,748 | gain | 1862 | TAF7L | Y | 1 | 2 | 2.95 | Exon+ve, 5 > ASD > 1, Normals < 2, Sanger−ve |
| 23 | 419 | 103231403 | 103239703 | 8,300 | gain | 1337 | MCART6 | Y | 1 | 2 | 2.95 | Exon+ve, 5 > ASD > 1, Normals < 2, Sanger−ve |
| 23 | 419 | 103231403 | 103239703 | 8,300 | gain | 1424 | MCART6 | Y | 1 | 2 | 2.95 | Exon+ve, 5 > ASD > 1, Normals < 2, Sanger−ve |
| 23 | 420 | 128777108 | 128780946 | 3,838 | gain | 1337 | ZDHHC9 | Y | 0 | 5 | 7.42 | Intron+ve, ASD > 4, Normals < 2, no Sanger filter applied |
| 23 | 420 | 128777108 | 128780946 | 3,838 | gain | 1459 | ZDHHC9 | Y | 0 | 5 | 7.42 | Intron+ve, ASD > 4, Normals < 2, no Sanger filter applied |
| 23 | 420 | 128777108 | 128780946 | 3,838 | gain | 1806 | ZDHHC9 | Y | 0 | 5 | 7.42 | Intron+ve, ASD > 4, Normals < 2, no Sanger filter applied |
| 23 | 420 | 128777108 | 128780946 | 3,838 | gain | 1824 | ZDHHC9 | Y | 0 | 5 | 7.42 | Intron+ve, ASD > 4, Normals < 2, no Sanger filter applied |
| 23 | 420 | 128777108 | 128780946 | 3,838 | gain | 2037 | ZDHHC9 | Y | 0 | 5 | 7.42 | Intron+ve, ASD > 4, Normals < 2, no Sanger filter applied |
| 23 | 421 | 130480966 | 130724109 | 243,143 | gain | 1337 | OR13H1, LOC286467 | Y | 1 | 3 | 4.44 | Exon+ve, 5 > ASD > 1, Normals < 2, Sanger−ve |
| 23 | 421 | 130480966 | 130724109 | 243,143 | gain | 1771 | OR13H1, LOC286467 | Y | 1 | 3 | 4.44 | Exon+ve, 5 > ASD > 1, Normals < 2, Sanger−ve |
| 23 | 421 | 130480966 | 130724109 | 243,143 | gain | 1940 | OR13H1, LOC286467 | Y | 1 | 3 | 4.44 | Exon+ve, 5 > ASD > 1, Normals < 2, Sanger−ve |
| 23 | 422 | 130724110 | 130732350 | 8,240 | gain | 1337 | LOC286467 | Y | 1 | 4 | 5.92 | Exon+ve, 5 > ASD > 1, Normals < 2, Sanger−ve |
| 23 | 422 | 130724110 | 130732350 | 8,240 | gain | 1464 | LOC286467 | Y | 1 | 4 | 5.92 | Exon+ve, 5 > ASD > 1, Normals < 2, Sanger−ve |
| 23 | 422 | 130724110 | 130732350 | 8,240 | gain | 1771 | LOC286467 | Y | 1 | 4 | 5.92 | Exon+ve, 5 > ASD > 1, Normals < 2, Sanger−ve |
| 23 | 422 | 130724110 | 130732350 | 8,240 | gain | 1940 | LOC286467 | Y | 1 | 4 | 5.92 | Exon+ve, 5 > ASD > 1, Normals < 2, Sanger−ve |
| 23 | 423 | 130742717 | 130797596 | 54,879 | gain | 1337 | LOC286467 | Y | 1 | 3 | 4.44 | Exon+ve, 5 > ASD > 1, Normals < 2, Sanger−ve |
| 23 | 423 | 130742717 | 130797596 | 54,879 | gain | 1771 | LOC286467 | Y | 1 | 3 | 4.44 | Exon+ve, 5 > ASD > 1, Normals < 2, Sanger−ve |
| 23 | 423 | 130742717 | 130797596 | 54,879 | gain | 1940 | LOC286467 | Y | 1 | 3 | 4.44 | Exon+ve, 5 > ASD > 1, Normals < 2, Sanger−ve |
| 23 | 424 | 140749582 | 140898529 | 148,947 | gain | 1337 | MAGEC1, MAGEC3 | Y | 1 | 2 | 2.95 | Exon+ve, 5 > ASD > 1, Normals < 2, Sanger−ve |
| 23 | 424 | 140749582 | 140898529 | 148,947 | gain | 1641 | MAGEC1, MAGEC3 | Y | 1 | 2 | 2.95 | Exon+ve, 5 > ASD > 1, Normals < 2, Sanger−ve |
| 23 | 425 | 144883013 | 144883778 | 765 | gain | 1337 | MIR890 | Y | 1 | 2 | 2.95 | Exon+ve, 5 > ASD > 1, Normals < 2, Sanger−ve |
| 23 | 425 | 144883013 | 144883778 | 765 | loss | 1585 | MIR890 | Y | 1 | 2 | 2.95 | Exon+ve, 5 > ASD > 1, Normals < 2, Sanger−ve |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 23 | 426 | 148491866 | 148507661 | 15,795 | gain | 1337 | TMEM185A | Y | 1 | 4 | 5.92 | Exon+ve, 5 > ASD > 1, Normals < 2, Sanger-ve |
| 23 | 426 | 148491866 | 148507661 | 15,795 | gain | 1429 | TMEM185A | Y | 1 | 4 | 5.92 | Exon+ve, 5 > ASD > 1, Normals < 2, Sanger-ve |
| 23 | 426 | 148491866 | 148507661 | 15,795 | loss | 1873 | TMEM185A | Y | 1 | 4 | 5.92 | Exon+ve, 5 > ASD > 1, Normals < 2, Sanger-ve |
| 23 | 426 | 148491866 | 148507661 | 15,795 | gain | 1967 | TMEM185A | Y | 1 | 4 | 5.92 | Exon+ve, 5 > ASD > 1, Normals < 2, Sanger-ve |
| 23 | 427 | 148515379 | 148517418 | 2,039 | gain | 1337 | TMEM185A | N | 1 | 5 | 7.42 | Intron+ve, ASD > 4, Normals < 2, no Sanger filter applied |
| 23 | 427 | 148515379 | 148517418 | 2,039 | gain | 1429 | TMEM185A | N | 1 | 5 | 7.42 | Intron+ve, ASD > 4, Normals < 2, no Sanger filter applied |
| 23 | 427 | 148515379 | 148517418 | 2,039 | gain | 1739 | TMEM185A | N | 1 | 5 | 7.42 | Intron+ve, ASD > 4, Normals < 2, no Sanger filter applied |
| 23 | 427 | 148515379 | 148517418 | 2,039 | loss | 1873 | TMEM185A | N | 1 | 5 | 7.42 | Intron+ve, ASD > 4, Normals < 2, no Sanger filter applied |
| 23 | 427 | 148515379 | 148517418 | 2,039 | gain | 1967 | TMEM185A | N | 1 | 5 | 7.42 | Intron+ve, ASD > 4, Normals < 2, no Sanger filter applied |
| 23 | 428 | 148573318 | 148609933 | 36,615 | gain | 1337 | MAGEA11 | Y | 1 | 4 | 5.92 | Exon+ve, 5 > ASD > 1, Normals < 2, Sanger-ve |
| 23 | 428 | 148573318 | 148609933 | 36,615 | gain | 1429 | MAGEA11 | Y | 1 | 4 | 5.92 | Exon+ve, 5 > ASD > 1, Normals < 2, Sanger-ve |
| 23 | 428 | 148573318 | 148609933 | 36,615 | gain | 1739 | MAGEA11 | Y | 1 | 4 | 5.92 | Exon+ve, 5 > ASD > 1, Normals < 2, Sanger-ve |
| 23 | 428 | 148573318 | 148609933 | 36,615 | gain | 1967 | MAGEA11 | Y | 1 | 4 | 5.92 | Exon+ve, 5 > ASD > 1, Normals < 2, Sanger-ve |
| 23 | 429 | 148856479 | 149008717 | 152,238 | gain | 1337 | CXorf40B, LOC100272228 | Y | 1 | 2 | 2.95 | Exon+ve, 5 > ASD > 1, Normals < 2, Sanger-ve |
| 23 | 429 | 148856479 | 149008717 | 152,238 | gain | 1429 | CXorf40B, LOC100272228 | Y | 1 | 2 | 2.95 | Exon+ve, 5 > ASD > 1, Normals < 2, Sanger-ve |
| 23 | 430 | 151770680 | 151788382 | 17,702 | gain | 1337 | NSDHL | Y | 1 | 2 | 2.95 | Exon+ve, 5 > ASD > 1, Normals < 2, Sanger-ve |
| 23 | 430 | 151770680 | 151788382 | 17,702 | gain | 1887 | NSDHL | Y | 1 | 2 | 2.95 | Exon+ve, 5 > ASD > 1, Normals < 2, Sanger-ve |
| 23 | 431 | 152787203 | 152793677 | 6,474 | gain | 1337 | L1CAM | Y | 1 | 2 | 2.95 | Exon+ve, 5 > ASD > 1, Normals < 2, Sanger-ve |
| 23 | 431 | 152787203 | 152793677 | 6,474 | loss | 1820 | L1CAM | Y | 1 | 2 | 2.95 | Exon+ve, 5 > ASD > 1, Normals < 2, Sanger-ve |
| 23 | 432 | 153232909 | 153256482 | 23,573 | gain | 1337 | FLNA | Y | 1 | 2 | 2.95 | Exon+ve, 5 > ASD > 1, Normals < 2, Sanger-ve |
| 23 | 432 | 153232909 | 153256482 | 23,573 | loss | 1907 | FLNA | Y | 1 | 2 | 2.95 | Exon+ve, 5 > ASD > 1, Normals < 2, Sanger-ve |
| 23 | 433 | 153864652 | 153867340 | 2,688 | gain | 1337 | F8 | Y | 1 | 2 | 2.95 | Exon+ve, 5 > ASD > 1, Normals < 2, Sanger-ve |
| 23 | 433 | 153864652 | 153867340 | 2,688 | gain | 1754 | F8 | Y | 1 | 2 | 2.95 | Exon+ve, 5 > ASD > 1, Normals < 2, Sanger-ve |
| 23 | 434 | 154395845 | 154404961 | 9,116 | gain | 1337 | TMLHE | Y | 1 | 2 | 2.95 | Exon+ve, 5 > ASD > 1, Normals < 2, Sanger-ve |
| 23 | 434 | 154395845 | 154404961 | 9,116 | gain | 1724 | TMLHE | Y | 1 | 2 | 2.95 | Exon+ve, 5 > ASD > 1, Normals < 2, Sanger-ve |
| 23 | 435 | 154456891 | 154456908 | 17 | gain | 1271 | TMLHE | N | 1 | 5 | 7.42 | Intron+ve, ASD > 4, Normals < 2, no Sanger filter applied |
| 23 | 435 | 154456891 | 154456908 | 17 | gain | 1337 | TMLHE | N | 1 | 5 | 7.42 | Intron+ve, ASD > 4, Normals < 2, no Sanger filter applied |
| 23 | 435 | 154456891 | 154456908 | 17 | loss | 1493 | TMLHE | N | 1 | 5 | 7.42 | Intron+ve, ASD > 4, Normals < 2, no Sanger filter applied |
| 23 | 435 | 154456891 | 154456908 | 17 | gain | 1950 | TMLHE | N | 1 | 5 | 7.42 | Intron+ve, ASD > 4, Normals < 2, no Sanger filter applied |
| 23 | 435 | 154456891 | 154456908 | 17 | loss | 2033 | TMLHE | N | 1 | 5 | 7.42 | Intron+ve, ASD > 4, Normals < 2, no Sanger filter applied |
| 29 | 436 | 279211 | 282240 | 3,029 | loss | 1704 | HMX1 | Y | 1 | 3 | 4.44 | Exon+ve, 5 > ASD > 1, Normals < 2, Sanger-ve |
| 29 | 436 | 279211 | 282240 | 3,029 | loss | 1727 | HMX1 | Y | 1 | 3 | 4.44 | Exon+ve, 5 > ASD > 1, Normals < 2, Sanger-ve |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Over lap | NVE | ASD | OR | Category |
|---|---|---|---|---|---|---|---|---|---|---|---|---|
| 29 | 436 | 279211 | 282240 | 3,029 | loss | 1883 | HMX1 | Y | 1 | 3 | 4.44 | Exon+ve, 5 > ASD > 1, Normals < 2, Sanger-ve |
| 29 | 437 | 282241 | 282257 | 16 | loss | 1704 | HMX1 | N | 1 | 8 | 11.92 | Intron+ve, ASD > 4, Normals < 2, no Sanger filter applied |
| 29 | 437 | 282241 | 282257 | 16 | loss | 1721 | HMX1 | N | 1 | 8 | 11.92 | Intron+ve, ASD > 4, Normals < 2, no Sanger filter applied |
| 29 | 437 | 282241 | 282257 | 16 | loss | 1727 | HMX1 | N | 1 | 8 | 11.92 | Intron+ve, ASD > 4, Normals < 2, no Sanger filter applied |
| 29 | 437 | 282241 | 282257 | 16 | loss | 1797 | HMX1 | N | 1 | 8 | 11.92 | Intron+ve, ASD > 4, Normals < 2, no Sanger filter applied |
| 29 | 437 | 282241 | 282257 | 16 | loss | 1874 | HMX1 | N | 1 | 8 | 11.92 | Intron+ve, ASD > 4, Normals < 2, no Sanger filter applied |
| 29 | 437 | 282241 | 282257 | 16 | loss | 1883 | HMX1 | N | 1 | 8 | 11.92 | Intron+ve, ASD > 4, Normals < 2, no Sanger filter applied |
| 29 | 437 | 282241 | 282257 | 16 | loss | 1955 | HMX1 | N | 1 | 8 | 11.92 | Intron+ve, ASD > 4, Normals < 2, no Sanger filter applied |
| 29 | 437 | 282241 | 282257 | 16 | loss | 1958 | HMX1 | N | 1 | 8 | 11.92 | Intron+ve, ASD > 4, Normals < 2, no Sanger filter applied |
| 34 | 438 | 583370 | 1141964 | 558,594 | loss | 1244 | C9orf169, RNF208 | Y | 2 | 40 | 31.25 | Genic (distinct CNV-subregions); OR > 6 |
| 34 | 438 | 583370 | 1141964 | 558,594 | gain | 1309 | C9orf169, RNF208 | Y | 2 | 40 | 31.25 | Genic (distinct CNV-subregions); OR > 6 |
| 34 | 438 | 583370 | 1141964 | 558,594 | gain | 1320 | C9orf169, RNF208 | Y | 2 | 40 | 31.25 | Genic (distinct CNV-subregions); OR > 6 |
| 34 | 438 | 583370 | 1141964 | 558,594 | gain | 1493 | C9orf169, RNF208 | Y | 2 | 40 | 31.25 | Genic (distinct CNV-subregions); OR > 6 |
| 34 | 438 | 583370 | 1141964 | 558,594 | gain | 1541 | C9orf169, RNF208 | Y | 2 | 40 | 31.25 | Genic (distinct CNV-subregions); OR > 6 |
| 34 | 438 | 583370 | 1141964 | 558,594 | gain | 1542 | C9orf169, RNF208 | Y | 2 | 40 | 31.25 | Genic (distinct CNV-subregions); OR > 6 |
| 34 | 438 | 583370 | 1141964 | 558,594 | gain | 1543 | C9orf169, RNF208 | Y | 2 | 40 | 31.25 | Genic (distinct CNV-subregions); OR > 6 |
| 34 | 438 | 583370 | 1141964 | 558,594 | gain | 1560 | C9orf169, RNF208 | Y | 2 | 40 | 31.25 | Genic (distinct CNV-subregions); OR > 6 |
| 34 | 438 | 583370 | 1141964 | 558,594 | gain | 1570 | C9orf169, RNF208 | Y | 2 | 40 | 31.25 | Genic (distinct CNV-subregions); OR > 6 |
| 34 | 438 | 583370 | 1141964 | 558,594 | gain | 1585 | C9orf169, RNF208 | Y | 2 | 40 | 31.25 | Genic (distinct CNV-subregions); OR > 6 |
| 34 | 438 | 583370 | 1141964 | 558,594 | gain | 1587 | C9orf169, RNF208 | Y | 2 | 40 | 31.25 | Genic (distinct CNV-subregions); OR > 6 |
| 34 | 438 | 583370 | 1141964 | 558,594 | gain | 1588 | C9orf169, RNF208 | Y | 2 | 40 | 31.25 | Genic (distinct CNV-subregions); OR > 6 |
| 34 | 438 | 583370 | 1141964 | 558,594 | gain | 1589 | C9orf169, RNF208 | Y | 2 | 40 | 31.25 | Genic (distinct CNV-subregions); OR > 6 |
| 34 | 438 | 583370 | 1141964 | 558,594 | gain | 1605 | C9orf169, RNF208 | Y | 2 | 40 | 31.25 | Genic (distinct CNV-subregions); OR > 6 |
| 34 | 438 | 583370 | 1141964 | 558,594 | gain | 1606 | C9orf169, RNF208 | Y | 2 | 40 | 31.25 | Genic (distinct CNV-subregions); OR > 6 |
| 34 | 438 | 583370 | 1141964 | 558,594 | loss | 1718 | C9orf169, RNF208 | Y | 2 | 40 | 31.25 | Genic (distinct CNV-subregions); OR > 6 |
| 34 | 438 | 583370 | 1141964 | 558,594 | loss | 1737 | C9orf169, RNF208 | Y | 2 | 40 | 31.25 | Genic (distinct CNV-subregions); OR > 6 |
| 34 | 438 | 583370 | 1141964 | 558,594 | loss | 1741 | C9orf169, RNF208 | Y | 2 | 40 | 31.25 | Genic (distinct CNV-subregions); OR > 6 |
| 34 | 438 | 583370 | 1141964 | 558,594 | loss | 1743 | C9orf169, RNF208 | Y | 2 | 40 | 31.25 | Genic (distinct CNV-subregions); OR > 6 |
| 34 | 438 | 583370 | 1141964 | 558,594 | loss | 1757 | C9orf169, RNF208 | Y | 2 | 40 | 31.25 | Genic (distinct CNV-subregions); OR > 6 |
| 34 | 438 | 583370 | 1141964 | 558,594 | loss | 1800 | C9orf169, RNF208 | Y | 2 | 40 | 31.25 | Genic (distinct CNV-subregions); OR > 6 |
| 34 | 438 | 583370 | 1141964 | 558,594 | loss | 1816 | C9orf169, RNF208 | Y | 2 | 40 | 31.25 | Genic (distinct CNV-subregions); OR > 6 |
| 34 | 438 | 583370 | 1141964 | 558,594 | loss | 1856 | C9orf169, RNF208 | Y | 2 | 40 | 31.25 | Genic (distinct CNV-subregions); OR > 6 |
| 34 | 438 | 583370 | 1141964 | 558,594 | loss | 1859 | C9orf169, RNF208 | Y | 2 | 40 | 31.25 | Genic (distinct CNV-subregions); OR > 6 |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| 34 | 438 | 583370 | 1141964 | 558,594 | loss | 1861 | C9orf169, RNF208 | Y | 2 | 40 | 31.25 | Genic (distinct CNV-subregions); OR > 6 |
| 34 | 438 | 583370 | 1141964 | 558,594 | gain | 1862 | C9orf169, RNF208 | Y | 2 | 40 | 31.25 | Genic (distinct CNV-subregions); OR > 6 |
| 34 | 438 | 583370 | 1141964 | 558,594 | loss | 1868 | C9orf169, RNF208 | Y | 2 | 40 | 31.25 | Genic (distinct CNV-subregions); OR > 6 |
| 34 | 438 | 583370 | 1141964 | 558,594 | loss | 1919 | C9orf169, RNF208 | Y | 2 | 40 | 31.25 | Genic (distinct CNV-subregions); OR > 6 |
| 34 | 438 | 583370 | 1141964 | 558,594 | loss | 1921 | C9orf169, RNF208 | Y | 2 | 40 | 31.25 | Genic (distinct CNV-subregions); OR > 6 |
| 34 | 438 | 583370 | 1141964 | 558,594 | loss | 1935 | C9orf169, RNF208 | Y | 2 | 40 | 31.25 | Genic (distinct CNV-subregions); OR > 6 |
| 34 | 438 | 583370 | 1141964 | 558,594 | loss | 1940 | C9orf169, RNF208 | Y | 2 | 40 | 31.25 | Genic (distinct CNV-subregions); OR > 6 |
| 34 | 438 | 583370 | 1141964 | 558,594 | loss | 1942 | C9orf169, RNF208 | Y | 2 | 40 | 31.25 | Genic (distinct CNV-subregions); OR > 6 |
| 34 | 438 | 583370 | 1141964 | 558,594 | loss | 1957 | C9orf169, RNF208 | Y | 2 | 40 | 31.25 | Genic (distinct CNV-subregions); OR > 6 |
| 34 | 438 | 583370 | 1141964 | 558,594 | loss | 1966 | C9orf169, RNF208 | Y | 2 | 40 | 31.25 | Genic (distinct CNV-subregions); OR > 6 |
| 34 | 438 | 583370 | 1141964 | 558,594 | loss | 1969 | C9orf169, RNF208 | Y | 2 | 40 | 31.25 | Genic (distinct CNV-subregions); OR > 6 |
| 34 | 438 | 583370 | 1141964 | 558,594 | loss | 2003 | C9orf169, RNF208 | Y | 2 | 40 | 31.25 | Genic (distinct CNV-subregions); OR > 6 |
| 34 | 438 | 583370 | 1141964 | 558,594 | loss | 2004 | C9orf169, RNF208 | Y | 2 | 40 | 31.25 | Genic (distinct CNV-subregions); OR > 6 |
| 34 | 438 | 583370 | 1141964 | 558,594 | loss | 2005 | C9orf169, RNF208 | Y | 2 | 40 | 31.25 | Genic (distinct CNV-subregions); OR > 6 |
| 34 | 438 | 583370 | 1141964 | 558,594 | loss | 2018 | C9orf169, RNF208 | Y | 2 | 40 | 31.25 | Genic (distinct CNV-subregions); OR > 6 |
| 34 | 438 | 583370 | 1141964 | 558,594 | loss | 2035 | C9orf169, RNF208 | Y | 2 | 40 | 31.25 | Genic (distinct CNV-subregions); OR > 6 |
| 40 | 439 | 408980 | 740717 | 331,737 | gain | 1477 | LOC727849, LOC80154, LOC440297 | Y | 1 | 3 | 4.44 | Exon+ve, 5 > ASD > 1, Normals < 2, Sanger−ve |
| 40 | 439 | 408980 | 740717 | 331,737 | gain | 1541 | LOC727849, LOC80154, LOC440297 | Y | 1 | 3 | 4.44 | Exon+ve, 5 > ASD > 1, Normals < 2, Sanger−ve |
| 40 | 439 | 408980 | 740717 | 331,737 | loss | 2022 | LOC727849, LOC80154, LOC440297 | Y | 1 | 3 | 4.44 | Exon+ve, 5 > ASD > 1, Normals < 2, Sanger−ve |
| 42 | 440 | 134605 | 405509 | 270,904 | gain | 1391 | KRT39, KRTAP1-1, KRTAP1-3, KRTAP1-5, KRTAP2-2, KRTAP2-1, KRTAP3-2, KRTAP3-3, KRTAP2-4, KRT40, KRTAP4-11, KRTAP3-1, KRTAP4-12, LOC730755 | Y | 1 | 3 | 4.44 | Exon+ve, 5 > ASD > 1, Normals < 2, Sanger−ve |
| 42 | 440 | 134605 | 405509 | 270,904 | gain | 1559 | KRT39, KRTAP1-1, KRTAP1-3, KRTAP1-5, KRTAP2-2, KRTAP2-1, KRTAP3-2, KRTAP3-3, KRTAP2-4, KRT40, KRTAP4-11, KRTAP3-1, KRTAP4-12, LOC730755 | Y | 1 | 3 | 4.44 | Exon+ve, 5 > ASD > 1, Normals < 2, Sanger−ve |
| 42 | 440 | 134605 | 405509 | 270,904 | gain | 1836 | KRT39, KRTAP1-1, KRTAP1-3, KRTAP1-5, KRTAP2-2, KRTAP2-1, | Y | 1 | 3 | 4.44 | Exon+ve, 5 > ASD > 1, Normals < 2, Sanger−ve |

TABLE 2-continued

| Chr | CNV Sub-region Number | CNV Subregion Start | CNV Subregion Stop | CNV Subregion Size | CNV Type | ASD Case ID(s) | RefSeq Gene Symbol(s) | Exon Overlap | NVE | ASD | OR | Category |
|---|---|---|---|---|---|---|---|---|---|---|---|---|
| | | | | | | | KRTAP3-2, KRTAP3-3, KRTAP2-4, KRT40, KRTAP4-11, KRTAP3-1, KRTAP4-12, LOC730755 | | | | | |
| 42 | 441 | 2174372 | 2319520 | 145,148 | loss | 1223 | PYCR1, LOC92659 | Y | 1 | 2 | 2.95 | Exon+ve, 5 > ASD > 1, Normals < 2, Sanger-ve |
| 42 | 441 | 2174372 | 2319520 | 145,148 | loss | 1872 | PYCR1, LOC92659 | Y | 1 | 2 | 2.95 | Exon+ve, 5 > ASD > 1, Normals < 2, Sanger-ve |
| 42 | 442 | 2319521 | 2332709 | 13,188 | loss | 1223 | GCGR | Y | 1 | 3 | 4.44 | Exon+ve, 5 > ASD > 1, Normals < 2, Sanger-ve |
| 42 | 442 | 2319521 | 2332709 | 13,188 | loss | 1727 | GCGR | Y | 1 | 3 | 4.44 | Exon+ve, 5 > ASD > 1, Normals < 2, Sanger-ve |
| 42 | 442 | 2319521 | 2332709 | 13,188 | loss | 1872 | GCGR | Y | 1 | 3 | 4.44 | Exon+ve, 5 > ASD > 1, Normals < 2, Sanger-ve |
| 42 | 443 | 2332710 | 2342015 | 9,305 | loss | 1223 | FAM195B | Y | 1 | 4 | 5.92 | Exon+ve, 5 > ASD > 1, Normals < 2, Sanger-ve |
| 42 | 443 | 2332710 | 2342015 | 9,305 | loss | 1727 | FAM195B | Y | 1 | 4 | 5.92 | Exon+ve, 5 > ASD > 1, Normals < 2, Sanger-ve |
| 42 | 443 | 2332710 | 2342015 | 9,305 | loss | 1872 | FAM195B | Y | 1 | 4 | 5.92 | Exon+ve, 5 > ASD > 1, Normals < 2, Sanger-ve |
| 42 | 443 | 2332710 | 2342015 | 9,305 | gain | 1891 | FAM195B | Y | 1 | 4 | 5.92 | Exon+ve, 5 > ASD > 1, Normals < 2, Sanger-ve |

TABLE 3

| Gene Number | Gene Name | Exon overlap | NCBI Gene ID | Gene Description | RefSeq Summary |
|---|---|---|---|---|---|
| 1 | ABCA13 | N | 154664 | ATP-binding cassette subfamily A member 13 | In human, the ATP-binding cassette (ABC) family of transmembrane transporters has at least 48 genes and 7 gene subfamilies. This gene is a member of ABC gene subfamily A (ABCA). Genes within the ABCA family typically encode several thousand amino acids. Like other ABC transmembrane transporter proteins, this protein has 12 or more transmembrane alpha-helix domains that likely arrange to form a single central chamber with multiple substrate binding sites. It is also predicted to have two large extracellular domains and two nucleotide binding domains as is typical for ABCA proteins. Alternative splice variants have been described but their biological validity has not been demonstrated.[provided by RefSeq, Mar 2009]. Sequence Note: This RefSeq record was created from transcript and genomic sequence data to make the sequence consistent with the reference genome assembly. The genomic coordinates used for the transcript record were based on transcript alignments. |
| 2 | ABCC6PI | Y | 653190 | N/A | N/A |
| 3 | ABHD3 | N | 171586 | abhydrolase domain-containing protein 3 | This gene encodes a protein containing an alpha/beta hydrolase fold, which is a catalytic domain found in a very wide range of enzymes. The function of this protein has not been determined. [provided by RefSeq, Jul 2008]. |
| 4 | ACACA | N | 31 | acetyl-CoA carboxylase 1 isoform 2 | Acetyl-CoA carboxylase (ACC) is a complex multifunctional enzyme system. ACC is a biotin-containing enzyme which catalyzes the carboxylation of acetyl-CoA to malonyl-CoA, the rate-limiting step in fatty acid synthesis. There are two ACC forms, alpha and beta, encoded by two different genes. ACC-alpha is highly enriched in lipogenic tissues. The enzyme is under long term control at the transcriptional and translational levels and under short term regulation by the phosphorylation/dephosphorylation of targeted serine residues and by allosteric transformation by citrate or palmitoyl-CoA. Multiple alternatively spliced transcript variants divergent in the 5 sequence and encoding distinct isoforms have been found for this gene. [provided by RefSeq, Jul 2008]. Transcript Variant: This variant (2) is the longest transcript, which has several additional exons in the 5' region, as compared to variant 1. It uses a downstream start codon and the resulting isoform (2) has a shorter N-terminus, as compared to isoform 1. |
| 5 | ACACB | Y | 32 | acetyl-CoA carboxylase 2 precursor | Acetyl-CoA carboxylase (ACC) is a complex multifunctional enzyme system. ACC is a biotin-containing enzyme which catalyzes the carboxylation of acetyl-CoA to malonyl-CoA, the rate-limiting step in fatty acid synthesis. ACC-beta is thought to control fatty acid oxidation by means of the ability of malonyl-CoA to inhibit carnitine-palmitoyl-CoA transferase I, the rate-limiting step in fatty acid uptake and oxidation by mitochondria. ACC-beta may be involved in the regulation of fatty acid oxidation, rather than fatty acid biosynthesis. There is evidence for the presence of two ACC-beta isoforms. [provided by RefSeq, Jul 2008]. |
| 6 | ACER2 | Y | 340485 | alkaline ceramidase 2 | The sphingolipid metabolite sphingosine- 1-phosphate promotes cell proliferation and survival, whereas its precursor, sphingosine, has the opposite effect. The ceramidase ACER2 hydrolyzes very long chain ceramides to generate sphingosine (Xu et al., 2006 [PubMed 16940153]).[supplied by OMIM, Jul 2010]. |
| 7 | ACOT11 | Y | 26027 | acyl-coenzyme A thioesterase 11 isoform 2 | This gene encodes a member of the acyl-CoA thioesterase family which catalyse the conversion of activated fatty acids to the corresponding non-esterified fatty acid and coenzyme A. Expression of a mouse homolog in brown adipose tissue is induced by low temperatures and repressed by warm temperatures. Higher levels of expression of the mouse homolog has been found in obesity-resistant mice compared with obesity-prone mice, suggesting a role of acyl-CoA thioesterase 11 in obesity. Alternative splicing results in transcript variants. [provided by RefSeq, Nov 2010]. Transcript Variant: This variant (2) uses alternate exons in the 3' coding region and UTR, compared to variant 1. The encoded isoform (BFIT2) has a distinct C-terminus compared to isoform BFIT1. Sequence Note: This RefSeq record was created from transcript and genomic sequence data to make the sequence consistent with the reference genome assembly. The genomic coordinates used for the transcript record were based on transcript alignments. |
| 8 | ADAM11 | Y | 4185 | disintegrin and metalloproteinase domain-containing protein 11 preproprotein | This gene encodes a member of the ADAM (a disintegrin and metalloprotease) protein family. Members of this family are membrane-anchored proteins structurally related to snake venom disintegrins, and have been implicated in a variety of biological processes involving cell-cell and cell-matrix interactions, including fertilization, muscle development, and neurogenesis. This gene represents a candidate tumor supressor gene for human breast cancer based on its location within a minimal region of chromosome 17q21 previously defined by tumor deletion mapping. [provided by RefSeq, Jul 2008]. |
| 9 | ADAM5P | Y | 255926 | N/A | N/A |
| 10 | ADM | Y | 133 | ADM precursor | Adrenomedullin, a hypotensive peptide found in human pheochromocytoma, consists of 52 amino acids, has 1 intramolecular disulfide bond, and shows a slight homology with the calcitonin gene-related peptide. It may function as a hormone in circulation control because it is found in blood in a considerable concentration. The precursor, called |

TABLE 3-continued

| Gene Number | Gene Name | Exon overlap | NCBI Gene ID | Gene Description | RefSeq Summary |
|---|---|---|---|---|---|
| | | | | | preproadrenomedullin, is 185 amino acids long. By RNA-blot analysis, human adrenomedullin mRNA was found to be highly expressed in several tissues. Genomic ADM DNA consists of 4 exons and 3 introns, with the 5-prime flanking region containing TATA, CAAT, and GC boxes. There are also multiple binding sites for activator protein-2 and a cAMP-regulated enhancer element. [provided by RefSeq, Jul 2008]. |
| 11 | AGR3 | Y | 155465 | anterior gradient protein 3 homolog precursor | N/A |
| 12 | AIM1 | Y | 202 | absent in melanoma 1 protein | N/A |
| 13 | ALDH1A2 | N | 8854 | retinal dehydrogenase 2 isoform 3 | This protein belongs to the aldehyde dehydrogenase family of proteins. The product of this gene is an enzyme that catalyzes the synthesis of retinoic acid (RA) from retinaldehyde. Retinoic acid, the active derivative of vitamin A (retinol), is a hormonal signaling molecule that functions in developing and adult tissues. The studies of a similar mouse gene suggest that this enzyme and the cytochrome CYP26A1, concurrently establish local embryonic retinoic acid levels which facilitate posterior organ development and prevent spina bifida. Four transcript variants encoding distinct isoforms have been identified for this gene. [provided by RefSeq, May 2011]. Transcript Variant: This variant (3) differs in the 5′ UTR and coding sequence compared to variant 1. The resulting isoform (3) is shorter at the N-terminus compared to isoform 1. |
| 14 | ALDOA | Y | 226 | fructose-bisphosphate aldolase A isoform 2 | The protein encoded by this gene, Aldolase A (fructose-1,6-bisphosphate aldolase), is a glycolytic enzyme that catalyzes the reversible conversion of fructose-1,6-bisphosphate to glyceraldehyde 3-phosphate and dihydroxyacetone phosphate. Three aldolase isozymes (A, B, and C), encoded by three different genes, are differentially expressed during development. Aldolase A is found in the developing embryo and is produced in even greater amounts in adult muscle. Aldolase A expression is repressed in adult liver, kidney and intestine and similar to aldolase C levels in brain and other nervous tissue. Aldolase A deficiency has been associated with myopathy and hemolytic anemia. Alternative splicing and alternative promoter usage results in multiple transcript variants. Related pseudogenes have been identified on chromosomes 3 and 10. [provided by RefSeq, Aug 2011]. Transcript Variant: This variant (6) differs in the 5′ UTR and 5′ coding region, and uses an alternate start codon, compared to variant 1. The resulting isoform (2) is longer at the N-terminus, compared to isoform 1. |
| 15 | ADMPD3 | Y | 272 | AMP deaminase 3 isoform 1C | This gene encodes a member of the AMP deaminase gene family. The encoded protein is a highly regulated enzyme that catalyzes the hydrolytic deamination of adenosine monophosphate to inosine monophosphate, a branch point in the adenylate catabolic pathway. This gene encodes the erythrocyte (E) isoforms, whereas other family members encode isoforms that predominate in muscle (M) and liver (L) cells. Mutations in this gene lead to the clinically asymptomatic, autosomal recessive condition erythrocyte AMP deaminase deficiency. Alternatively spliced transcript variants encoding different isoforms of this gene have been described. [provided by RefSeq, Jul 2008]. Transcript Variant: This variant (3) contains an alternate, in-frame exon for its 5′ UTR and 5′ coding region and initiates translation at an alternate start codon, compared to variant 1. It encodes isoform 1C, which has a shorter, distinct N-terminus, compared to isoform 1A. |
| 16 | AMY2B | N | 280 | alpha-amylase 2B precursor | Amylases are secreted proteins that hydrolyze 1,4-alpha-glucoside bonds in oligosaccharides and polysaccharides, and thus catalyze the first step in digestion of dietary starch and glycogen. The human genome has a cluster of several amylase genes that are expressed at high levels in either salivary gland or pancreas. This gene encodes an amylase isoenzyme produced by the pancreas. |
| 17 | ANAPC1 | Y | 64682 | anaphase-promoting complex subunit 1 | ANAPC1 is 1 of at least 10 subunits of the anaphase-promoting complex (APC), which functions at the metaphase-to-anaphase transition of the cell cycle and is regulated by spindle checkpoint proteins. The APC is an E3 ubiquitin ligase that targets cell cycle regulatory proteins for degradation by the proteasome, thereby allowing progression through the cell cycle. [supplied by OMIM, Apr 2004]. |
| 18 | ANKRD33B | N | 651746 | ankyrin repeat domain-containing protein 33B | N/A |
| 19 | ANKRD44 | both | 91526 | serine/threonine-protein phosphatase 6 regulatory ankyrin repeat subunit B | N/A |
| 20 | ANUBL1 | Y | N/A | N/A | N/A |
| 21 | APBA1 | Y | 320 | amyloid beta A4 precursor protein-binding family A member 1 | The protein encoded by this gene is a member of the X11 protein family. It is a neuronal adapter protein that interacts with the Alzheimer's disease amyloid precursor protein (APP). It stabilizes APP and inhibits production of proteolytic APP fragments including the A beta peptide that is deposited in the brains of Alzheimer's disease patients. This gene product is |

TABLE 3-continued

| Gene Number | Gene Name | Exon overlap | NCBI Gene ID | Gene Description | RefSeq Summmary |
|---|---|---|---|---|---|
| 22 | APBA2 | Y | 321 | amyloid beta A4 precursor protein-binding family A member 2 isoform b | believed to be involved in signal transduction processes. It is also regarded as a putative vesicular trafficking protein in the brain that can form a complex with the potential to couple synaptic vesicle exocytosis to neuronal cell adhesion. [provided by RefSeq, Jul 2008]. The protein encoded by this gene is a member of the X11 protein family. It is a neuronal adapter protein that interacts with the Alzheimer's disease amyloid precursor protein (APP). It stabilizes APP and inhibits production of proteolytic APP fragments including the A beta peptide that is deposited in the brains of Alzheimer's disease patients. This gene product is believed to be involved in signal transduction processes. It is also regarded as a putative vesicular trafficking protein in the brain that can form a complex with the potential to couple synaptic vesicle exocytosis to neuronal cell adhesion. Multiple transcript variants encoding different isoforms have been found for this gene. [provided by RefSeq, Jul 2008]. Transcript Variant: This variant (2) lacks an alternate in-frame exon, compared to variant 1, resulting in a shorter protein (isoform b), compared to isoform a. Publication Note: This RefSeq record includes a subset of the publications that are available for this gene. Please see the Gene record to access additional publications. |
| 23 | APOBEC3A | Y | 200315 | probable DNA dC->dU-editing enzyme APOBEC-3A | This gene is a member of the cytidine deaminase gene family. It is one of seven related genes or pseudogenes found in a cluster, thought to result from gene duplication, on chromosome 22. Members of the cluster encode proteins that are structurally and functionally related to the C to U RNA-editing cytidine deaminase APOBEC1. The protein encoded by this gene lacks the zinc binding activity of other family members. The protein plays a role in immunity, by restricting transmission of foreign DNA such as viruses. One mechanism of foreign DNA restriction is deamination of foreign double-stranded DNA cytidines to uridines, which leads to DNA degradation. However, other mechanisms are also thought to be involved, as anti-viral effect is not dependent on deaminase activity. One allele of this gene results from the deletion of approximately 29.5 kb of sequence between this gene, APOBEC3A, and the adjacent gene APOBEC3B. The breakpoints of the deletion are within the two genes, so the deletion allele is predicted to have the promoter and coding region of APOBEC3A, but the 3 UTR of APOBEC3B. [provided by RefSeq, Jul 2010]. Transcript Variant: This variant (2) represents the deletion allele; its 5' UTR and coding region are derived from APOBEC3A, while its 3' UTR is derived from APOBEC3B. Variants 1 and 2 encode the same protein. |
| 24 | APOO | Y | 79135 | apolipoprotein O precursor | This gene is a member of the apolipoprotein family. Members of this protein family are involved in the transport and metabolism of lipids. The encoded protein associates with HDL, LDL and VLDL lipoproteins and is characterized by chondroitin-sulfate glycosylation. This protein may be involved in preventing lipid accumulation in the myocardium in obese and diabetic patients. Alternative splicing results in multiple transcript variants. Pseudogenes of this gene are found on chromosomes 3, 4, 5, 12 and 16.[provided by RefSeq, Sep 2009]. Transcript Variant: This variant (1) represents the longer transcript and is predicted to encode the functional protein. |
| 25 | ARMC10 | Y | 83787 | armadillo repeat-containing protein 10 isoform f | This gene encodes a protein that contains an armadillo repeat and transmembrane domain. The encoded protein decreases the transcriptional activity of the tumor suppressor protein p53 through direct interaction with the DNA-binding domain of p53, and may play a role in cell growth and survival. Upregulation of this gene may play a role in hepatocellular carcinoma. Alternatively spliced transcript variants encoding multiple isoforms have been observed for this gene, and a pseudogene of this gene is located on the long arm of chromosome 3. [provided by RefSeq, Sep 2011]. Transcript Variant: This variant (F) lacks three in-frame exons in the coding region compared to variant A. This results in a shorter protein (isoform f) compared to isoform a. |
| 26 | ARSF | Y | 416 | arylsulfatase F precursor | This gene is a member of the sulfatase family, and more specifically, the arylsulfatase subfamily. Members of the subfamily share similarity in sequence and splice sites, and are clustered together on chromosome X, suggesting that they are derived from recent gene duplication events. Sulfatases are essential for the correct composition of bone and cartilage matrix. The activity of this protein, unlike that of arylsulfatase E, is not inhibited by warfarin. Multiple alternatively spliced variants, encoding the same protein, have been identified.[provided by RefSeq, Jan 2011]. Transcript Variant: This variant (3) differs in the 5' UTR compared to variant 1. Variants 1, 2 and 3 encode the same protein. Sequence Note: This RefSeq record was created from transcript and genomic sequence data to make the sequence consistent with the reference genome assembly. The genomic coordinates used for the transcript record were based on transcript alignments. |
| 27 | ARVCF | 7 | 421 | armadillo repeat protein deleted in velo-cardio-facial syndrome | Armadillo Repeat gene deleted in Velo-Cardio-Facial syndrome (ARVCF) is a member of the catenin family. This family plays an important role in the formation of adherens junction complexes, which are thought to facilitate communication between the inside and outside environments of a cell. The ARVCF gene was isolated in the search for the genetic defect responsible for the autosomal dominant Velo-Cardio-Facial syndrome (VCFS), a relatively common human disorder with phenotypic features including cleft palate, conotruncal heart defects and facial dysmorphology. The ARVCF gene encodes |

TABLE 3-continued

| Gene Number | Gene Name | Exon overlap | NCBI Gene ID | Gene Description | RefSeq Summary |
|---|---|---|---|---|---|
| 28 | ASPHD1 | Y | 253982 | aspartate beta-hydroxylase domain-containing protein 1 | a protein containing two motifs, a coiled coil domain in the N-terminus and a 10 armadillo repeat sequence in the midregion. Since these sequences can facilitate protein-protein interactions ARVCF is thought to function in a protein complex. In addition, ARVCF contains a predicted nuclear-targeting sequence suggesting that it may have a function as a nuclear protein. [provided by RefSeq, Jun 2010]. Publication Note: This RefSeq record includes a subset of the publications that are available for this gene. Please see the Gene record to access additional publications. |
| 29 | ATP6V0E2 | Y | 155066 | V-type proton ATPase subunit e 2 isoform 2 | Multisubunit vacuolar-type proton pumps, or H(+)-ATPases, acidify various intracellular compartments, such as vacuoles, clathrin-coated and synaptic vesicles, endosomes, lysosomes, and chromaffin granules. H(+)-ATPases are also found in plasma membranes of specialized cells, where they play roles in urinary acidification, bone resorption, and sperm maturation. Multiple subunits form H(+)-ATPases, with proteins of the V1 class hydrolyzing ATP for energy to transport H+, and proteins of the V0 class forming an integral membrane domain through which H* is transported. ATP6V0E2 encodes an isoform of the H(+)-ATPase V0 e subunit, an essential proton pump component (Blake-Palmer et al., 2007 [PubMed 17350184]).[supplied by OMIM, Mar 2008]. Transcript Variant: This variant (2) lacks an alternate segment in the 3 coding region, compared to variant 1, that causes a frameshift. The resulting protein (isoform 2) has a longer and distinct C-terminus, compared to isoform 1. |
| 30 | ATRNL1 | N | 26033 | attractin-like protein 1 precursor | N/A |
| 31 | ATXN2 | N | 6311 | ataxin-2 | The autosomal dominant cerebellar ataxias (ADCA) are a heterogeneous group of neurodegenerative disorders characterized by progressive degeneration of the cerebellum, brain stem and spinal cord. Clinically, ADCA has been divided into three groups: ADCA types I-III. Defects in this gene are the cause of spinocerebellar ataxia type 2 (SCA2). SCA2 belongs to the autosomal dominant cerebellar ataxias type I (ADCA I) which are characterized by cerebellar ataxia in combination with additional clinical features like optic atrophy, ophthalmoplegia, bulbar and extrapyramidal signs, peripheral neuropathy and dementia. SCA2 is caused by expansion of a CAG repeat in the coding region of this gene. This locus has been mapped to chromosome 12, and it has been determined that the diseased allele contains 37-50 CAG repeats, compared to 17-29 in the normal allele. Longer expansions result in earlier onset of the disease. Alternatively spliced transcript variants encoding different isoforms have been identified but their full length sequence has not been determined. [provided by RefSeq, Jan 2010]. |
| 32 | BARD1 | Y | 580 | BRCA1-associated RING domain protein 1 | This gene encodes a protein which interacts with the N-terminal region of BRCA1. In addition to its ability to bind BRCA1 in vivo and in vitro, it shares homology with the 2 most conserved regions of BRCA1: the N-terminal RING motif and the C-terminal BRCT domain. The RING motif is a cysteine-rich sequence found in a variety of proteins that regulate cell growth, including the products of tumor suppressor genes and dominant protooncogenes. This protein also contains 3 tandem ankyrin repeats. The BARD1/BRCA1 interaction is disrupted by tumorigenic amino acid substitutions in BRCA1, implying that the formation of a stable complex between these proteins may be an essential aspect of BRCA1 tumor suppression. This protein may be the target of oncogenic mutations in breast or ovarian cancer. [provided by RefSeq, Jul 2008]. |
| 33 | BCAS1 | N | 8537 | breast carcinoma-amplified sequence 1 | This gene resides in a region at 20q13 which is amplified in a variety of tumor types and associated with more aggressive tumor phenotypes. Among the genes identified from this region, it was found to be highly expressed in three amplified breast cancer cell lines and in one breast tumor without amplification at 20q13.2. However, this gene is not in the common region of maximal amplification and its expression was not detected in the breast cancer cell line MCF7, in which this region is highly amplified. Although not consistently expressed, this gene is a candidate oncogene. [provided by RefSeq, Jul 2008]. Sequence Note: The RefSeq transcript and protein were derived from genomic sequence to make the sequence consistent with the reference genome assembly. The genomic coordinates used for the transcript record were based on alignments. |
| 34 | BCKDHB | N | 594 | 2-oxoisovalerate dehydrogenase subunit beta, mitochondrial precursor | Branched-chain keto acid dehydrogenase is a multienzyme complex associated with the inner membrane of mitochondria, and functions in the catabolism of branched-chain amino acids. The complex consists of multiple copies of 3 components: branched-chain alpha-keto acid decarboxylase (E1), lipoamide acyltransferase (E2) and lipoamide dehydrogenase (E3). This gene encodes the E1 beta subunit, and mutations therein have been associated with maple syrup urine disease (MSUD), type 1B, a disease characterized by a maple syrup odor to the urine in addition to mental and physical retardation, and feeding problems. Alternative splicing at this locus results in transcript variants with different 3 non- |

TABLE 3-continued

| Gene Number | Gene Name | Exon overlap | NCBI Gene ID | Gene Description | RefSeq Summmary |
|---|---|---|---|---|---|
| | | | | | coding regions, but encoding the same isoform. [provided by RefSeq, Jul 2008]. Transcript Variant: This variant (2) is missing a segment in the 3' UTR compared to transcript variant 1, and thus has a shorter 3' UTR. Both variants 1 and 2 encode the same protein. |
| 35 | BRD7P3 | Y | 23629 | N/A | N/A |
| 36 | BTNL8 | Y | 79908 | | N/A |
| 37 | C10orf11 | N | 83938 | | N/A |
| 38 | C14orf145 | N | N/A | N/A | N/A |
| 39 | C16orf53 | Y | 79447 | PAXIP1-associated protein 1 | C16ORF53 (PA1) is a component of a Set 1-like multiprotein histone methyltransferase complex (Cho et al., 2007 [PubMed 17500065]).[supplied by OMIM, May 2008]. Sequence Note: This RefSeq record was created from transcript and genomic sequence data because no single transcript was available for the full length of the gene. The extent of this transcript is supported by transcript alignments. |
| 40 | C16orf54 | Y | 283897 | transmembrane protein C16orf54 | N/A |
| 41 | C16orf90 | Y | 646174 | uncharacterized protein C16 orf90 | N/A |
| 42 | C16orf92 | Y | 146378 | uncharacterized protein C16orf92 isoform 1 precursor | N/A |
| 43 | C1orf106 | Y | 55765 | uncharacterized protein C1orf106 isoform 2 | N/A |
| 44 | C1orf152 | Y | N/A | N/A | N/A |
| 45 | C21orf58 | Y | 54058 | uncharacterized protein C21orf58 | N/A |
| 46 | C22orf25 | Y | 128989 | uncharacterized protein C22orf25 | N/A |
| 47 | C22orf29 | Y | 79680 | uncharacterized protein C22orf29 | N/A |
| 48 | C22orfB9 | Y | 128977 | UPF0545 protein C22orf39 isoform 2 | N/A |
| 49 | C6orf127 | V | 340204 | colipase-like protein C6orf127 precursor | N/A |
| 50 | C6orf162 | Y | 57150 | UPF0708 protein C6orf162 | N/A |
| 51 | C6orf204 | Y | N/A | N/A | N/A |
| 52 | C6orf204 | both | N/A | N/A | N/A |
| 53 | C7orf50 | N | 84310 | uncharacterized protein C7orf50 | N/A |
| 54 | C9orf102 | N | 375748 | RAD26L hypothetical protein | N/A |
| 55 | C9orf169 | Y | 37591 | UPF0574 protein C9orf169 | N/A |
| 56 | C9orf85 | Y | 138241 | uncharacterized protein | N/A |
| 57 | CA5BP1 | Y | 340591 | N/A | N/A |
| 58 | CABS1 | Y | 85438 | testis development protein NYD-SP26 | N/A |
| 59 | CALN1 | N | 83698 | calcium-binding protein 8 isoform | This gene encodes a protein with high similarity to the calcium-binding proteins of the calmodulin family. The encoded protein contains two EF-hand domains and potential calcium-binding sites. Alternative splicing results in multiple transcript variants. [provided by RefSeq, Jul 2008]. Transcript Variant: This variant (2) differs in the 5 UTR compared to variant 1. |
| 60 | CAMSAP1L1 | Y | N/A | N/A | N/A |
| 61 | CAPG | Y | 822 | macrophage-capping protein | This gene encodes a member of the gelsolin/villin family of actin-regulatory proteins. The encoded protein reversibly blocks the barbed ends of F-actin filaments in a Ca2+and phosphoinositide-regulated manner, but does not sever |

TABLE 3-continued

| Gene Number | Gene Name | Exon overlap | NCBI Gene ID | Gene Description | RefSeq Summary |
|---|---|---|---|---|---|
| | | | | | preformed actin filaments. By capping the barbed ends of actin filaments, the encoded protein contributes to the control of actin-based motility in non-muscle cells. Alternatively spliced transcript variants have been observed, but have not been fully described. [provided by RefSeq, Jul 2008]. |
| 62 | CCDC50 | N | 152137 | coiled-coil domain-containing protein 50 short isoform | This gene encodes a soluble, cytoplasmic, tyrosine-phosphorylated protein with multiple ubiquitin-interacting domains. Mutations in this gene cause nonsyndromic, postlingual, progressive sensorineural DFNA44 hearing loss. In mouse, the protein is expressed in the inner ear during development and postnatal maturation and associates with microtubule-based structures. This protein may also function as a negative regulator of NF-kB signaling and as an effector of epidermal growth factor (EGF)-mediated cell signaling. Alternative splicing results in multiple transcript variants encoding distinct isoforms. [provided by RefSeq, Oct 2008]. Transcript Variant: This variant (1) lacks an in-frame exon in the coding region, compared to variant 2, and encodes the short isoform. Sequence Note: The RefSeq transcript and protein were derived from transcript and genomic sequence to make the sequence consistent with the reference genome assembly. The extent of this transcript is supported by transcript alignments. Publication Note: This RefSeq record includes a subset of the publications that are available for this gene. Please see the Gene record to access additional publications. |
| 63 | CCDC66 | N | 285331 | coiled-coil domain-containing protein 66 isoform 1 | N/A |
| 64 | CD177 | Y | 57126 | CD177 antigen precursor | NB1, a glycosyl-phosphatidylinositol (GPI)-linked N-glycosylated cell surface glycoprotein, was first described in a case of neonatal alloimmune neutropenia (Lalezari et al., 1971 [PubMed 5552408]).[supplied by OMIM, Mar 2008]. Publication Note: This RefSeq record includes a subset of the publications that are available for this gene. Please see the Gene record to access additional publications. |
| 65 | CDC45 | Y | 8318 | cell division control protein 45 homolog isoform 2 | The protein encoded by this gene was identified by its strong similarity with Saccharomyces cerevisiae Cdc45, an essential protein required for the initiation of DNA replication. Cdc45 is a member of the highly conserved multiprotein complex including Cdc6/Cdc18, the minichromosome maintenance proteins (MCMs) and DNA polymerase, which is important for early steps of DNA replication in eukaryotes. This protein has been shown to interact with MCM7 and DNA polymerase alpha. Studies of the similar gene in Xenopus suggested that this protein play a pivotal role in the loading of DNA polymerase alpha onto chromatin. Multiple alternatively spliced transcript variants encoding different isoforms have been found for this gene. [provided by RefSeq, May 2010]. Transcript Variant: This variant (2) lacks an in-frame exon in the CDS, as compared to variant 1. The resulting isoform (2) lacks an internal segment, as compared to isoform 1. |
| 66 | CDH17 | N | 1015 | cadherin-17 precursor | This gene is a member of the cadherin superfamily, genes encoding calcium-dependent, membrane-associated glycoproteins. The encoded protein is cadherin-like, consisting of an extracellular region, containing 7 cadherin domains, and a transmembrane region but lacking the conserved cytoplasmic domain. The protein is a component of the gastrointestinal tract and pancreatic ducts, acting as an intestinal proton-dependent peptide transporter in the first step in oral absorption of many medically important peptide-based drugs. The protein may also play a role in the morphological organization of liver and intestine. Alternative splicing results in multiple transcript variants. [provided by RefSeq, Jan 2009]. Transcript Variant: This variant (2) differs in the 5′ UTR compared to variant 1. Both variants 1 and 2 encode the same protein. |
| 67 | CDIPT | Y | 10423 | CDP-diacylglycerol-inositol 3-phosphatidyltransferase | Phosphatidylinositol breakdown products are ubiquitous second messengers that function downstream of many G protein-coupled receptors and tyrosine kinases regulating cell growth, calcium metabolism, and protein kinase C activity. Two enzymes, CDP-diacylglycerol synthase and phosphatidylinositol synthase, are involved in the biosynthesis of phosphatidylinositol. Phosphatidylinositol synthase, a member of the CDP-alcohol phosphatidyl transferase class-I family, is an integral membrane protein found on the cytoplasmic side of the endoplasmic reticulum and the Golgi apparatus. [provided by RefSeq, Jul 2008]. |
| 68 | CENPVL1 | Y | 389857 | N/A | N/A |
| 69 | CEP110 | N | N/A | N/A | N/A |
| 70 | CFH | Y | 3075 | complement factor H isoform b precursor | This gene is a member of the Regulator of Complement Activation (RCA) gene cluster and encodes a protein with twenty short consensus repeat (SCR) domains. This protein is secreted into the bloodstream and has an essential role in the regulation of complement activation, restricting this innate defense mechanism to microbial infections. Mutations in this gene have been associated with hemolytic-uremic syndrome (HUS) and chronic hypocomplementemic nephropathy. Alternate transcriptional splice variants, encoding different isoforms, have been characterized. [provided by RefSeq, Oct 2011]. Transcript Variant: This variant (2) utilizes an alternate terminal exon which results in an early stop codon. The |

TABLE 3-continued

| Gene Number | Gene Name | Exon overlap | NCBI Gene ID | Gene Description | RefSeq Summmary |
|---|---|---|---|---|---|
| 71 | CHL1 | Y | 10752 | neural cell adhesion molecule L1-like protein precursor | resulting protein (isoform b, also known as the 'factor H-like 1' or 'FHL-1' isoform) has a distinct C-terminus and is shorter than isoform a. The protein encoded by this gene is a member of the L1 gene family of neural cell adhesion molecules. It is a neural recognition molecule that may be involved in signal transduction pathways. The deletion of one copy of this gene may be responsible for mental defects in patients with 3p- syndrome. Several alternatively spliced transcript variants of this gene have been described, but their full length nature is not known. [provided by RefSeq, Jul 2008]. |
| 72 | CHPT1 | N | 56994 | cholinephosphotransferase 1 | N/A |
| 73 | CHTF18 | Y | 63922 | chromosome transmission fidelity protein 18 homolog | CHTF18, CHTF8 (MIM 613202), and DCC1 (DSCC1; MIM 613203) are components of an alternative replication factor C (RFC) (see MIM 600404) complex that loads PCNA (MIM 176740) onto DNA during S phase of the cell cycle (Merkle et al., 2003 [PubMed 12766176]; Bermudez et al., 2003 [PubMed 12930902]).[supplied by OMIM, Dec 2009]. |
| 74 | CIB2 | Y | 10518 | calcium and integrin-binding family member 2 | The amino acid sequence the protein encoded by this gene is similar to that of KIP/CIB, calcineurin B, and calmodulin. This suggests that the encoded protein may be a Ca2+-binding regulatory protein that interacts with DNA-dependent protein kinase catalytic subunit (DNA-PKcs). [provided by RefSeq, Jul 2008]. |
| 75 | CKAP2L | Y | 150468 | cytoskeleton-associated protein 2-like | N/A |
| 76 | CLDN5 | Y | 7122 | claudin-5 | This gene encodes a member of the claudin family. Claudins are integral membrane proteins and components of tight junction strands. Tight junction strands serve as a physical barrier to prevent solutes and water from passing freely through the paracellular space between epithelial or endothelial cell sheets. Mutations in this gene have been found in patients with velocardiofacial syndrome. Alternatively spliced transcript variants encoding the same protein have been found for this gene. [provided by RefSeq, Aug 2008]. Transcript Variant: This variant (2) lacks a segment in the 5' UTR, as compared to variant 1. |
| 77 | CLEC18C | Y | 283971 | C-type lectin domain family 18 member C precursor | N/A |
| 78 | CLEC3A | Y | 10143 | C-type lectin domain family 3 member A isoform 1 precursor | N/A |
| 79 | CLSTN1 | N | 22883 | calsyntenin-1 isoform 1 precursor | N/A |
| 80 | CLTCL1 | Y | 8218 | clathrin heavy chain 2 isoform 2 | This gene is a member of the clathrin heavy chain family and encodes a major protein of the polyhedral coat of coated pits and vesicles. Chromosomal aberrations involving this gene are associated with meningioma, DiGeorge syndrome, and velo-cardio-facial syndrome. Multiple transcript variants encoding different isoforms have been found for this gene. [provided by RefSeq, Jun 2009]. Transcript Variant: This variant (2) lacks an alternate in-frame exon in the 3' coding region, compared to variant 1. The resulting isoform (2) lacks an internal segment near the C-terminus, compared to isoform 1. |
| 81 | CLUAP1 | Y | 23059 | clusterin-associated protein 1 isoform 2 | N/A |
| 82 | CMTM8 | | | CKLF-like MARVEL transmembrane domain-containing protein 8 | This gene belongs to the chemokine-like factor gene superfamily, a novel family that is similar to the chemokine and the transmembrane 4 superfamilies. This gene is one of several chemokine-like factor genes located in a cluster on chromosome 3. This gene is widely expressed in many tissues, but the exact function of the encoded protein is unknown. [provided by RefSeq, Jul 2008]. |
| 83 | CNBD1 | | | cyclic nucleotide-binding domain-containing protein 1 | N/A |
| 84 | CNR1 | | | cannabinoid receptor 1 isoform b | This gene encodes one of two cannabinoid receptors. The cannabinoids, principally delta-9-tetrahydrocannabinol and synthetic analogs, are psychoactive ingredients of marijuana. The cannabinoid receptors are members of the guanine-nucleotide-binding protein (G-protein) coupled receptor family, which inhibit adenylate cyclase activity in a dose-dependent, stereoselective and pertussis toxin-sensitive manner. The two receptors have been found to be involved in the cannabinoid-induced CNS effects (including alterations in mood and cognition) experienced by users of marijuana. Multiple transcript variants encoding two different protein isoforms have been described for this gene. [provided by RefSeq, May 2009]. Transcript Variant: This variant (2) lacks an internal segment near the 5 end of the coding region, |

TABLE 3-continued

| Gene Number | Gene Name | Exon overlap | NCBI Gene ID | Gene Description | RefSeq Summary |
|---|---|---|---|---|---|
| 85 | CNTN4 | | | contactin-4 isoform a precursor | compared to variant 1. The resulting protein (isoform b) has a shorter and distinct N-terminus compared to isoform a. PubMed ID: 15620723 referred to this variant and its protein as CB1b. This gene encodes a member of the contactin family of immunoglobulins. Contactins are axon-associated cell adhesion molecules that function in neuronal network formation and plasticity. The encoded protein is a glycosylphosphatidylinositol-anchored neuronal membrane protein that may play a role in the formation of axon connections in the developing nervous system. Deletion or mutation of this gene may play a role in the formation of 3p deletion syndrome and autism spectrum disorders. Alternative splicing results in multiple transcript variants. [provided by RefSeq, May 2011]. Transcript Variant: This variant (1) encodes the longest isoform (a). Both variants 1 and 4 encode the same isoform. |
| 86 | CNTNAP2 | | | contactin-associated protein-like 2 precursor | This gene encodes a member of the neurexin family which functions in the vertebrate nervous system as cell adhesion molecules and receptors. This protein, like other neurexin proteins, contains epidermal growth factor repeats and laminin G domains. In addition, it includes an F5/8 type C domain, discoidin/neuropilin- and fibrinogen-like domains, thrombospondin N-terminal-like domains and a putative PDZ binding site. This protein is localized at the juxtaparanodes of myelinated axons, and mediates interactions between neurons and glia during nervous system development and is also involved in localization of potassium channels within differentiating axons. This gene encompasses almost 1.5% of chromosome 7 and is one of the largest genes in the human genome. It is directly bound and regulated by forkhead box protein P2 (FOXP2), a transcription factor related to speech and language development. This gene has been implicated in multiple neurodevelopmental disorders, including Gilles de la Tourette syndrome, schizophrenia, epilepsy, autism, ADHD and mental retardation, [provided by RefSeq, Mar 2010]. Sequence Note: This RefSeq record was created from transcript and genomic sequence data to make the sequence consistent with the reference genome assembly. The genomic coordinates used for the transcript record were based on transcript alignments. |
| 87 | CNTNAP4 | N | 85445 | contactin-associated protein-like 4 isoform 1 precursor | This gene product belongs to the neurexin family, members of which function in the vertebrate nervous system as cell adhesion molecules and receptors. This protein, like other neurexin proteins, contains epidermal growth factor repeats and laminin G domains. In addition, it includes an F5/8 type C domain, discoidin/neuropilin- and fibrinogen-like domains, and thrombospondin N-terminal-like domains. Alternative splicing results in two transcript variants encoding different isoforms. [provided by RefSeq, Jul 2008]. Transcript Variant: This variant (1) encodes the longer isoform (1). Sequence Note: This RefSeq record was created from transcript and genomic sequence data because no single transcript was available for the full length of the gene. The extent of this transcript is supported by transcript alignments. |
| 88 | COMT | Y | 1312 | catechol O-methyltransferase isoform S-COMT | Catechol-O-methyltransferase catalyzes the transfer of a methyl group from S-adenosylmethionine to catecholamines, including the neurotransmitters dopamine, epinephrine, and norepinephrine. This 0-methylation results in one of the major degradative pathways of the catecholamine transmitters. In addition to its role in the metabolism of endogenous substances, COMT is important in the metabolism of catechol drugs used in the treatment of hypertension, asthma, and Parkinson disease. COMT is found in two forms in tissues, a soluble form (S-COMT) and a membrane-bound form (MB-COMT). The differences between S-COMT and MB-COMT reside within the N-termini. Several transcript variants are formed through the use of alternative translation initiation sites and promoters. [provided by RefSeq, Sep 2008]. Transcript Variant: This variant (4, also known as S-COMT) contains a shorter 5' UTR and a translation start site which lies 50 codons downstream compared to that of variant 1. The resulting isoform (S-COMT) is shorter at the N-terminus compared to isoform MB-COMT. S-COMT is a soluble protein. Sequence Note: This RefSeq record was created from transcript and genomic sequence data because no single transcript was available for the full length of the gene. The extent of this transcript is supported by transcript alignments. |
| 89 | CORO1A | Y | 11151 | coronin-1A | This gene encodes a member of the WD repeat protein family. WD repeats are minimally conserved regions of approximately 40 amino acids typically bracketed by gly-his and trp-asp (GH-WD), which may facilitate formation of heterotrimeric or multiprotein complexes. Members of this family are involved in a variety of cellular processes, including cell cycle progression, signal transduction, apoptosis, and gene regulation. Alternative splicing results in multiple transcript variants. A related pseudogene has been defined on chromosome 16. [provided by RefSeq, Sep 2010]. Transcript Variant: This variant (2) differs in the 5 UTR compared to variant 1. Both variants 1 and 2 encode the same protein. |
| 90 | COX6A1 | Y | 1337 | cytochrome c oxidase subunit 6A1, mitochondrial precursor | Cytochrome c oxidase (COX), the terminal enzyme of the mitochondrial respiratory chain, catalyzes the electron transfer from reduced cytochrome c to oxygen. It is a heteromeric complex consisting of 3 catalytic subunits encoded by mitochondrial genes and multiple structural subunits encoded by nuclear genes. The mitochondrially-encoded subunits function in the electron transfer and the nuclear-encoded subunits may function in the regulation and assembly of the complex. This nuclear gene encodes polypeptide 1 (liver isoform) of subunit VIa, and polypeptide 1 is found in all non- |

TABLE 3-continued

| Gene Number | Gene Name | Exon overlap | NCBI Gene ID | Gene Description | RefSeq Summmary |
|---|---|---|---|---|---|
| | | | | | muscle tissues. Polypeptide 2 (heart/muscle isoform) of subunit VIa is encoded by a different gene, and is present only in striated muscles. These two polypeptides share 66% amino acid sequence identity. It has been reported that there may be several pseudogenes on chromosomes 1,6, 7q21, 7q31-32 and 12. However, only one pseudogene (COX6A1P) on chromosome 1p31.1 has been documented. [provided by RefSeq, Jul 2008]. |
| 91 | CRKL | Y | 1399 | crk-like protein | This gene encodes a protein kinase containing 5H2 and 5H3 (src homology) domains which has been shown to activate the RAS and JUN kinase signaling pathways and transform fibroblasts in a RAS-dependent fashion. It is a substrate of the BCR-ABL tyrosine kinase, plays a role in fibroblast transformation by BCR-ABL, and may be oncogenic.[provided by RefSeq, Jan 2009]. |
| 92 | CRKL | both | 1399 | crk-like protein | This gene encodes a protein kinase containing 5H2 and 5H3 (src homology) domains which has been shown to activate the RAS and JUN kinase signaling pathways and transform fibroblasts in a RAS-dependent fashion. It is a substrate of the BCR-ABL tyrosine kinase, plays a role in fibroblast transformation by BCR-ABL, and may be oncogenic.[provided by RefSeq, Jan 2009]. |
| 93 | CROCC | Y | 9696 | rootletin | N/A |
| 94 | CSGALNACT2 | Y | 55454 | chondroitin sulfate N-acetylgalactosaminyl-transferase 2 | N/A |
| 95 | CSMD3 | N | 114788 | CUB and sushi domain-containing protein 3 isoform 3 | N/A |
| 96 | CSPG4 | Y | 1464 | chondroitin sulfate proteoglycan 4 precursor | A human melanoma-associated chondroitin sulfate proteoglycan plays a role in stabilizing cell-substratum interactions during early events of melanoma cell spreading on endothelial basement membranes. CSPG4 represents an integral membrane chondroitin sulfate proteoglycan expressed by human malignant melanoma cells. [provided by RefSeq, Jul 2008]. |
| 97 | CTAGE5 | N | 4253 | cutaneous T-cell lymphoma-associated antigen 5 isoform 7 | The protein encoded by this gene is a tumor-associated antigen found in cutaneous T-cell lymphoma and several other cancers. Autoantibodies against the encoded protein have been found in some cancers. Several transcript variants encoding different isoforms have been found for this gene. [provided by RefSeq, Oct 2011]. Transcript Variant: This variant (7) lacks a portion of the 5' coding region and initiates translation at a downstream start codon compared to variant 6. The resulting isoform (7) is shorter at the N-terminus compared to isoform 6. Sequence Note: This RefSeq record was created from transcript and genomic sequence data to make the sequence consistent with the reference genome assembly. The genomic coordinates used for the transcript record were based on transcript alignments. |
| 98 | CTNNA3 | Y | 29119 | catenin alpha-3 | N/A |
| 99 | CTNND2 | Y | 1501 | catenin delta-a | This gene encodes an adhesive junction associated protein of the armadillo/beta-catenin superfamily and is implicated in brain and eye development and cancer formation. The protein encoded by this gene promotes the disruption of E-cadherin based adherens junction to favor cell spreading upon stimulation by hepatocyte growth factor. This gene is overexpressed in prostate adenocarcinomas and is associated with decreased expression of tumor suppressor E-cadherin in this tissue. This gene resides in a region of the short arm of chromosome 5 that is deleted in Cri du Chat syndrome. [provided by RefSeq, Aug 2010]. |
| 100 | CXorf27 | Y | 25763 | huntingtin-interacting protein M | This gene encodes a protein shown to interact with huntingtin, which contains an expanded polyglutamine tract in individuals with Huntington's disease (PMID: 9700202). [provided by RefSeq, Aug 2011]. |
| 101 | CXorf40B | Y | 541578 | protein CXorf40B | N/A |
| 102 | CYP2A6 | Y | 1548 | cytochrome P450 2A6 precursor | This gene, CYP2A6, encodes a member of the cytochrome P450 superfamily of enzymes. The cytochrome P450 proteins are monooxygenases which catalyze many reactions involved in drug metabolism and synthesis of cholesterol, steroids and other lipids. This protein localizes to the endoplasmic reticulum and its expression is induced by phenobarbital. The enzyme is known to hydroxylate coumarin, and also metabolizes nicotine, aflatoxin B1, nitrosamines, and some pharmaceuticals. Individuals with certain allelic variants are said to have a poor metabolizer phenotype, meaning they do not efficiently metabolize coumarin or nicotine. This gene is part of a large cluster of cytochrome P450 genes from the CYP2A, CYP2B and CYP2F subfamilies on chromosome 19q. The gene was formerly referred to as CYP2A3; however, it has been renamed CYP2A6. [provided by RefSeq, Jul 2008]. |
| 103 | DCC | N | 1630 | netrin receptor DCC | This gene encodes a netrin 1 receptor. The transmembrane protein is a member of the immunoglobulin superfamily of cell adhesion molecules, and mediates axon guidance of neuronal growth cones towards sources of netrin 1 ligand. The |

TABLE 3-continued

| Gene Number | Gene Name | Exon overlap | NCBI Gene ID | Gene Description | RefSeq Summary |
|---|---|---|---|---|---|
| 104 | DCLRE1C | Y | 64421 | protein artemis isoform a | cytoplasmic tail interacts with the tyrosine kinases Src and focal adhesion kinase (FAK, also known as PTK2) to mediate axon attraction. The protein partially localizes to lipid rafts, and induces apoptosis in the absence of ligand. The protein functions as a tumor suppressor, and is frequently mutated or downregulated in colorectal cancer and esophageal carcinoma. [provided by RefSeq, Oct 2009]. Sequence Note: This RefSeq record was created from transcript and genomic sequence data to make the sequence consistent with the reference genome assembly. The genomic coordinates used for the transcript record were based on transcript alignments. This gene encodes a nuclear protein that is involved in V(D)J recombination and DNA repair. The protein has single-strand-specific 5'-3' exonuclease activity; it also exhibits endonuclease activity on 5' and 3' overhangs and hairpins when complexed with protein kinase, DNA-activated, catalytic polypeptide. Mutations in this gene cause Athabascan-type severe combined immunodeficiency (SCIDA). [provided by RefSeq, Jul 2008]. Transcript Variant: This variant (a) encodes the longest isoform (a). |
| 105 | DDT | Y | 1652 | D-dopachrome decarboxylase | D-dopachrome tautomerase converts D-dopachrome into 5,6-dihydroxyindole. The DDT gene is related to the migration inhibitory factor (MIF) in terms of sequence, enzyme activity, and gene structure. DDT and MIF are closely linked on chromosome 22. [provided by RefSeq, Jul 2008]. Transcript Variant: This variant (2) differs in the 5' UTR compared to variant 1. Variants 1 and 2 encode the same protein. |
| 106 | DDTL | Y | 100037417 | D-dopachrome decarboxylase-like protein | N/A |
| 107 | DDX53 | Y | 168400 | DEAD box protein 53 | This intronless gene encodes a protein which contains several domains found in members of the DEAD-box helicase protein family. Other members of this protein family participate in ATP-dependent RNA unwinding. [provided by RefSeq, Sep 2011]. |
| 108 | DEFA5 | Y | 1670 | defensin-5 preproprotein | Defensins are a family of microbicidal and cytotoxic peptides thought to be involved in host defense. They are abundant in the granules of neutrophils and also found in the epithelia of mucosal surfaces such as those of the intestine, respiratory tract, urinary tract, and vagina. Members of the defensin family are highly similar in protein sequence and distinguished by a conserved cysteine motif. Several of the alpha defensin genes appear to be clustered on chromosome 8. The protein encoded by this gene, defensin, alpha 5, is highly expressed in the secretory granules of Paneth cells of the ileum. [provided by RefSeq, Jul 2008]. |
| 109 | DGCR11 | Y | 25786 | N/A | N/A |
| 110 | DGCR14 | Y | 8220 | protein DGCR14 | This gene is located within the minimal DGS critical region (MDGCR) thought to contain the gene(s) responsible for a group of developmental disorders. These disorders include DiGeorge syndrome, velocardiofacial syndrome, conotruncal anomaly face syndrome, and some familial or sporadic conotruncal cardiac defects which have been associated with microdeletion of 22q11.2. The encoded protein may be a component of C complex spliceosomes, and the orthologous protein in the mouse localizes to the nucleus. [provided by RefSeq, Jul 2008]. |
| 111 | DGCR2 | Y | 9993 | integral membrane protein DGCR2/IDD isoform 4 precursor | Deletions of the 22q11.2 have been associated with a wide range of developmental defects (notably DiGeorge syndrome, velocardiofacial syndrome, conotruncal anomaly face syndrome and isolated conotruncal cardiac defects) classified under the acronym CATCH 22. The DGCR2 gene encodes a novel putative adhesion receptor protein, which could play a role in neural crest cells migration, a process which has been proposed to be altered in DiGeorge syndrome. Alternative splicing results in multiple transcript variants.[provided by RefSeq, May 2010]. Transcript Variant: This variant (4) uses an alternate in-frame splice site in the 5' coding region, compared to variant 1. The resulting isoform (4) lacks a short internal segment, compared to isoform 1. |
| 112 | DGCR8 | Y | 54487 | microprocessor complex subunit DGCR8 isoform 1 | This gene encodes a subunit of the microprocessor complex which mediates the biogenesis of microRNAs from the primary microRNA transcript. The encoded protein is a double-stranded RNA binding protein that functions as the non-catalytic subunit of the microprocessor complex. This protein is required for binding the double-stranded RNA substrate and facilitates cleavage of the RNA by the ribonuclease III protein, Drosha. Alternate splicing results in multiple transcript variants. [provided by RefSeq, Jun 2010]. Transcript Variant: This variant (1) represents the longer transcript and encodes the longer isoform (1). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| 113 | DMD | Y | 1756 | dystrophin Dp140c isoform | The dystrophin gene is the largest gene found in nature, measuring 2.4 Mb. The gene was identified through a positional cloning approach, targeted at the isolation of the gene responsible for Duchenne (DMD) and Becker (BMD) Muscular |

TABLE 3-continued

| Gene Number | Gene Name | Exon overlap | NCBI Gene ID | Gene Description | RefSeq Summmary |
|---|---|---|---|---|---|
| | | | | | Dystrophies. 1)M1) is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, Jul 2008]. Transcript Variant: Dp140 transcripts use exons 45-79, starting at a promoter/exon 1 located in intron 44. Dp140 transcripts have a long (1 kb) 5' UTR since translation is initiated in exon 51 (corresponding to aa 2461 of dystrophin). In addition to the alternative promoter and exon 1, differential splicing of exons 71-74 and 78 produces at least five Dp 140 isoforms. Of these, this transcript (Dp 140c) lacks exons 71-74. Sequence Note: This RefSeq record was created from transcript and genomic sequence data to make the sequence consistent with the reference genome assembly. The genomic coordinates used for the transcript record were based on transcript alignments. |
| 114 | DNAJC15 | Y | 29103 | dnaJ homolog subfamily C member 15 | N/A |
| 115 | DOC2A | Y | 8448 | double C2-like domain-containing protein alpha | There are at least two protein isoforms of the Double C2 protein, namely alpha (DOC2A) and beta (DOC2B), which contain two C2-like domains. DOC2A and DOC2B are encoded by different genes; these genes are at times confused with the unrelated DAB2 gene which was initially named DOC-2. DOC2A is mainly expressed in brain and is suggested to be involved in Ca(2+)-dependent neurotransmitter release, [provided by RefSeq, Jul 2008]. Publication Note: This RefSeq record includes a subset of the publications that are available for this gene. Please see the Gene record to access additional publications. |
| 116 | DOCK5 | N | 80005 | dedicator of cytokinesis protein 5 | N/A |
| 117 | DOK6 | N | 220164 | docking protein 6 | DOK6 is a member of the DOK (see DOK1; MIM 602919) family of intracellular adaptors that play a role in the RET (MIM 164761) signaling cascade (Crowder et al., 2004 [PubMed 15286081]).[supplied by OMIM, Mar 2008]. Sequence Note: This RefSeq record was created from transcript and genomic sequence data to make the sequence consistent with the reference genome assembly. The genomic coordinates used for the transcript record were based on transcript alignments. |
| 118 | DDP10 | N | 57628 | inactive dipeptidyl peptidase 10 isoform b | This gene encodes a single-pass type II membrane protein that is a member of the S9B family in clan SC of the serine proteases. This protein has no detectable protease activity, most likely due to the absence of the conserved serine residue normally present in the catalytic domain of serine proteases. However, it does bind specific voltage-gated potassium channels and alters their expression and biophysical properties. Alternate transcriptional splice variants, encoding different isoforms, have been characterized. [provided by RefSeq, Jul 2008]. Transcript Variant: This variant (4) has an alternate 5' exon. as compared to variant 3. The resulting isoform (b) has a shorter and distinct N-terminus when compared to isoform c. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| 119 | DPP6 | N | 1804 | | This gene encodes a single-pass type II membrane protein that is a member of the S9B family in clan SC of the serine proteases. This protein has no detectable protease activity, most likely due to the absence of the conserved serine residue normally present in the catalytic domain of serine proteases. However, it does bind specific voltage-gated potassium channels and alters their expression and biophysical properties. Alternate transcriptional splice variants, encoding different isoforms, have been characterized. [provided by RefSeq, Jul 2008]. Transcript Variant: This variant (2) includes an alternate in-frame exon, compared to variant 1, resulting in a shorter protein (isoform 2, also referred to as S) that has a shorter and distinct N-terminus, compared to isoform 1. Sequence Note: This RefSeq record was created from transcript and genomic sequence data to make the sequence consistent with the reference genome assembly. The genomic |

TABLE 3-continued

| Gene Number | Gene Name | Exon overlap | NCBI Gene ID | Gene Description | RefSeq Summmary |
|---|---|---|---|---|---|
| 120 | EDA2R | Y | 60401 | | coordinates used for the transcript record were based on transcript alignments. Publication Note: This RefSeq record includes a subset of the publications that are available for this gene. Please see the Gene record to access additional publications. EDA-A1 and EDA-A2 are two isoforms of ectodysplasin that are encoded by the anhidrotic ectodermal dysplasia (EDA) gene. Mutations in EDA give rise to a clinical syndrome characterized by loss of hair, sweat glands, and teeth. The protein encoded by this gene specifically binds to EDA-A2 isoform. This protein is a type III transmembrane protein of the TNFR (tumor necrosis factor receptor) superfamily, and contains 3 cysteine-rich repeats and a single transmembrane domain but lacks an N-terminal signal peptide. Alternatively spliced transcript variants have been found for this gene. [provided by RefSeq, May 2011]. Transcript Variant: This variant (3) contains an alternate exon and uses an alternate splice site in the 3' coding region but maintains the reading frame compared to variant 1. The resulting protein (isoform 2) is longer compared to isoform 1. Sequence Note: This RefSeq record was created from transcript and genomic sequence data to make the sequence consistent with the reference genome assembly. The genomic coordinates used for the transcript record were based on transcript alignments. |
| 121 | ELMOD3 | Y | 84173 | ELMO domain containing protein 3 isoform b | N/A |
| 122 | ENOX1 | Y | 55068 | ecto-NOX disulfide-thiol exhanger 1 | Electron transport pathways are generally associated with mitochondrial membranes, but non-mitochondrial pathways are also biologically significant. Plasma membrane electron transport pathways are involved in functions as diverse as cellular defense, intracellular redox homeostasis, and control of cell growth and survival. Members of the ecto-NOX family, such as CNOX, or ENOX1, are involved in plasma membrane transport pathways. These enzymes exhibit both a hydroquinone (NADH) oxidase activity and a protein disulfide-thiol interchange activity in series, with each activity cycling every 22 to 26 minutes (Scarlett et al., 2005 [PubMed 15882838]).[supplied by OMIM, Mar 2008]. Transcript Variant: This variant (3) differs in the 5' UTR compared to variant 1. Variants 1, 2 and 3 encode the same protein. Sequence Note: This RefSeq record was created from transcript and genomic sequence data to make the sequence consistent with the reference genome assembly. The genomic coordinates used for the transcript record were based on transcript alignments. |
| 123 | EXOSC6 | Y | 118460 | exosome complex component MTR3 | This gene product constitutes one of the subunits of the multisubunit particle called exosome, which mediates mRNA degradation. The composition of human exosome is similar to its yeast counterpart. This protein is homologous to the yeast Mtr3 protein. Its exact function is not known, however, it has been shown using a cell-free RNA decay system that the exosome is required for rapid degradation of unstable mRNAs containing AU-rich elements (AREs), but not for poly(A) shortening. The exosome does not recognize ARE-containing mRNAs on its own, but requires ARE-binding proteins that could interact with the exosome and recruit it to unstable mRNAs, thereby promoting their rapid degradation. [provided by RefSeq, Jul 2008]. |
| 124 | EYA2 | N | 2139 | eyes absent homolog 2 isoform a | This gene encodes a member of the eyes absent (EYA) family of proteins. The encoded protein may be post-translationally modified and may play a role in eye development. A similar protein in mice can act as a transcriptional activator. Alternative splicing results in multiple transcript variants, but the full-length natures of all of these variants have not yet been determined. [provided by RefSeq, Jul 2009]. Transcript Variant: This variant (1), also known as EYA2I, represents the longer transcript and encodes the longer isoform (a). Sequence Note: The RefSeq transcript and protein were derived from genomic sequence to make the sequence consistent with the reference genome assembly. The genomic coordinates used for the transcript record were based on alignments. |
| 125 | F8 | Y | 2157 | coagulation factor VIII isoform a precursor | This gene encodes coagulation factor VIII, which participates in the intrinsic pathway of blood coagulation; factor VIII is a cofactor for factor IXa which, in the presence of $Ca^{2+}$ and phospholipids, converts factor X to the activated form Xa. This gene produces two alternatively spliced transcripts. Transcript variant 1 encodes a large glycoprotein, isoform a, which circulates in plasma and associates with von Willebrand factor in a noncovalent complex. This protein undergoes multiple cleavage events. Transcript variant 2 encodes a putative small protein, isoform b, which consists primarily of the phospholipid binding domain of factor VIIIc. This binding domain is essential for coagulant activity. Defects in this gene results in hemophilia A, a common recessive X-linked coagulation disorder. [provided by RefSeq, Jul 2008]. Transcript Variant: This variant (1) consists of 26 exons and encodes the full-length isoform (a). |
| 126 | FAM195B | Y | 348262 | protein FAM195B | N/A |
| 127 | FAM57B | Y | 83723 | protein FAM57B | N/A |
| 128 | FAM5C | N | 339479 | protein FAM5C precursor | N/A |

TABLE 3-continued

| Gene Number | Gene Name | NCBI Gene ID | Gene Description | Exon overlap | RefSeq Summmary |
|---|---|---|---|---|---|
| 129 | FBXL13 | 222235 | F-box/LRR-repeat protein 13 isoform 2 | Y | Members of the F-box protein family, such as FBXL13, are characterized by an approximately 40-amino acid F-box motif. SCF complexes, formed by SKP1 (MIM 601434), cullin (see CUL1; MIM 603134), and F-box proteins, act as protein-ubiquitin ligases. F-box proteins interact with SKP1 through the F box, and they interact with ubiquitination targets through other protein interaction domains (Jin et al., 2004 [PubMed 15520277]).[supplied by OMIM, Mar 2008]. Transcript Variant: This variant (2) contains a different segment in the 5 UTR and lacks an alternate in-frame segment in the 3' CDS, compared to variant 1. The resulting protein (isoform 2) is shorter when it is compared to isoform 1. |
| 130 | FCGR1A | 2209 | high affinity immunoglobulin gamma Fc receptor I precursor | Y | This gene encodes a protein that plays an important role in the immune response. This protein is a high-affinity Fc-gamma receptor. The gene is one of three related gene family members located on chromosome 1. [provided by RefSeq, Jul 2008]. |
| 131 | FCGR1C | 100132417 | N/A | Y | The gene represents one of three related immunoglobulin gamma Fc receptor genes located on chromosome 1. This family member lacks the transmembrane and coiled-coiled domains found in other family members and is thought to be a pseudogene of Fc-gamma-receptor 1A. [provided by RefSeq, Apr 2009]. Sequence Note: The RefSeq transcript was derived from the reference genome assembly. The genomic coordinates were determined from alignments. |
| 132 | FGF14 | 2259 | fibroblast growth factor 14 isoform 1A | N | The protein encoded by this gene is a member of the fibroblast growth factor (FGF) family. FGF family members possess broad mitogenic and cell survival activities, and are involved in a variety of biological processes, including embryonic development, cell growth, morphogenesis, tissue repair, tumor growth and invasion. A mutation in this gene is associated with autosomal dominant cerebral ataxia. Alternatively spliced transcript variants have been found for this gene. [provided by RefSeq, Jul 2008]. Transcript Variant: This variant (1) encodes the shorter isoform (1A). Sequence Note: This RefSeq record was created from transcript and genomic sequence data because no single transcript was available for the full length of the gene. The extent of this transcript is supported by transcript alignments. |
| 133 | FGL1 | 2267 | fibrinogen-like protein 1 precursor | Y | Fibrinogen-like 1 is a member of the fibrinogen family. This protein is homologous to the carboxy terminus of the fibrinogen beta- and gamma- subunits which contains the four conserved cysteines of fibrinogens and fibrinogen related proteins. However, this protein lacks the platelet-binding site, cross-linking region and a thrombin-sensitive site which are necessary for fibrin clot formation. This protein may play a role in the development of hepatocellular carcinomas. Four alternatively spliced transcript variants encoding the same protein exist for this gene. [provided by RefSeq, Jul 2008]. Transcript Variant: This variant (4) represents the longest transcript. All four variants encode the same protein. Publication Note: This RefSeq record includes a subset of the publications that are available for this gene. Please see the Gene record to access additional publications. |
| 134 | FHIT | 2272 | bis(5'-adenosyl)-triphosphatase | N | This gene, a member of the histidine triad gene family, encodes a diadenosine 5',5-P1,P3-triphosphate hydrolase involved in purine metabolism. The gene encompasses the common fragile site FRA3B on chromosome 3, where carcinogen-induced damage can lead to translocations and aberrant transcripts of this gene. In fact, aberrant transcripts from this gene have been found in about half of all esophageal, stomach, and colon carcinomas. Alternatively spliced transcript variants have been found for this gene. [provided by RefSeq, Oct 2009]. Transcript Variant: This variant (2) has an alternate splice site in the 3' UTR, as compared to variant 1. Both variants 1 and 2 encode the same protein. |
| 135 | FLJ34690 | 284034 | N/A | N | N/A |
| 136 | FLNA | 2316 | filamin-A isoform 2 | Y | The protein encoded by this gene is an actin-binding protein that crosslinks actin filaments and links actin filaments to membrane glycoproteins. The encoded protein is involved in remodeling the cytoskeleton to effect changes in cell shape and migration. This protein interacts with integrins, transmembrane receptor complexes, and second messengers. Defects in this gene are a cause of several syndromes, including periventricular nodular heterotopias (PVNH1, PVNH4), otopalatodigital syndromes (OPD1, OPD2), frontometaphyseal dysplasia (FMD), Melnick-Needles syndrome (MNS), and X-linked congenital idiopathic intestinal pseudoobstruction (CIIPX). Two transcript variants encoding different isoforms have been found for this gene. [provided by RefSeq, Mar 2009]. Transcript Variant: This variant (2) includes an alternate in-frame exon and encodes a slightly longer protein isoform (2). |
| 137 | FLT1 | 2321 | vascular endothelial growth factor receptor 1 isoform 4 precursor | N | This gene encodes a member of the vascular endothelial growth factor receptor (VEGFR) family. VEGFR family members are receptor tyrosine kinases (RTKs) which contain an extracellular ligand-binding region with seven immunoglobulin (Ig)-like domains, a transmembrane segment, and a tyrosine kinase (TK) domain within the cytoplasmic domain. This protein binds to VEGFR-A, VEGFR-B and placental growth factor and plays an important role in angiogenesis and vasculogenesis. Expression of this receptor is found in vascular endothelial cells, placental trophoblast cells and peripheral blood monocytes. Multiple transcript variants encoding different isoforms have been found for this gene. Isoforms include a full-length transmembrane receptor isoform and shortened, soluble isoforms. The soluble isoforms are associated with |

TABLE 3-continued

| Gene Number | Gene Name | Exon overlap | NCBI Gene ID | Gene Description | RefSeq Summmary |
|---|---|---|---|---|---|
| | | | | | the onset of pre-eclampsia. [provided by RefSeq, May 2009]. Transcript Variant: This variant (4) differs in the 3 coding region and 3' UTR, compared to variant 1. The encoded soluble protein (isoform 4) has a shorter, distinct C-terminus and lacks the transmembrane and cytoplasmic regions of isoform 1. |
| 138 | FRG1B | Y | 284802 | N/A | N/A |
| 139 | GALNTL6 | N | 442117 | polypeptide N-acetylgalactosaminyl-transferase-like 6 | N/A |
| 140 | GATC | Y | 283459 | N/A | N/A |
| 141 | GCGR | Y | 2642 | glucagon receptor precursor | The protein encoded by this gene is a glucagon receptor that is important in controlling blood glucose levels. Defects in this gene are a cause of non-insulin-dependent diabetes mellitus (NIDDM).[provided by RefSeq, Jan 2010]. |
| 142 | GDPD3 | Y | 79153 | glycerophosphodiester phosphodiesterase domain-containing protein 3 | N/A |
| 143 | GJB7 | Y | 375519 | gap junction beta-7 protein | Connexins, such as GJB7, are involved in the formation of gap junctions, intercellular conduits that directly connect the cytoplasms of contacting cells. Each gap junction channel is formed by docking of 2 hemichannels, each of which contains 6 connexin subunits (Sohl et al., 2003 [PubMed 12881038]).[supplied by OMIM, Mar 2008]. |
| 144 | GLG1 | Y | 2734 | Golgi apparatus protein 1 isoform 3 precursor | N/A |
| 145 | GLOD5 | Y | 392465 | glyoxalase domain-containing protein 5 | This gene encodes a protein with a glyoxalase domain. [provided by RefSeq, Sep 2011]. |
| 146 | GLRA3 | N | 8001 | glycine receptor subunit alpha-3 isoform a precursor | The GLRA3 gene encodes the alpha-3 subunit of the neuronal glycine receptor, a ligand-gated chloride channel composed of ligand-binding alpha and structural beta polypeptides (Kingsmore et al., 1994 [PubMed 7894176]).[supplied by OMIM, Nov 2009]. |
| 147 | GNB1L | Y | 54584 | guanine nucleotide-binding protein subunit beta-like protein 1 | This gene encodes a G-protein beta-subunit-like polypeptide which is a member of the WD repeat protein family. WD repeats are minimally conserved regions of approximately 40 amino acids typically bracketed by gly-his and trp-asp (GH-WD), which may facilitate formation of heterotrimeric or multiprotein complexes. Members of this family are involved in a variety of cellular processes, including cell cycle progression, signal transduction, apoptosis, and gene regulation. This protein contains 6 WD repeats and is highly expressed in the heart. The gene maps to the region on chromosome 22q11, which is deleted in DiGeorge syndrome, trisomic in derivative 22 syndrome and tetrasomic in cat-eye syndrome. Therefore, this gene may contribute to the etiology of those disorders. Transcripts from this gene share some exons with some transcripts from the C22orf29 gene. [provided by RefSeq, Jul 2008]. Publication Note: This RefSeq record includes a subset of the publications that are available for this gene. Please see the Gene record to access additional publications. |
| 148 | GNG13 | Y | 51764 | guanine nucleotide-binding protein G(I)/G(S)/G(0) subunit gamma-13 precursor | Heterotrimeric G proteins, which consist of alpha (see MIM 139320), beta (see MIM 139380), and gamma subunits, function as signal transducers for the 7-transmembrane-helix G protein-coupled receptors. GNG13 is a gamma subunit that is expressed in taste, retinal, and neuronal tissues and plays a key role in taste transduction (Li et al., 2006 [PubMed 16473877]).[supplied by OMIM, Oct 2009]. |
| 149 | GOLGA8A | Y | 23015 | N/A | The Golgi apparatus, which participates in glycosylation and transport of proteins and lipids in the secretory pathway, consists of a series of stacked, flattened membrane sacs referred to as cisternae. Interactions between the Golgi and microtubules are thought to be important for the reorganization of the Golgi after it fragments during mitosis. The golgins constitute a family of proteins which are localized to the Golgi. This gene encodes a golgin which structurally resembles its family member GOLGA2, suggesting that they may share a similar function. There are many similar copies of this gene on chromosome 15. Alternative splicing results in multiple transcript variants. [provided by RefSeq, Mar 2009]. Transcript Variant: This variant (2) represents use of an alternate upstream promoter, contains additional 5 exons, and retains an intron, compared to variant 1. This variant is represented as non-coding because the transcript is a candidate for nonsense-mediated mRNA decay (NMD). Sequence Note: The RefSeq transcript was derived from the reference genome assembly. The genomic coordinates were determined from alignments. |
| 150 | GOLGA8E | Y | 390535 | N/A | N/A |
| 151 | GOLGA8IP | Y | 283796 | N/A | N/A |

TABLE 3-continued

| Gene Number | Gene Name | Exon overlap | NCBI Gene ID | Gene Description | RefSeq Summmary |
|---|---|---|---|---|---|
| 152 | GP1BB | Y | 2812 | platelet glycoprotein Ib beta chain precursor | Platelet glycoprotein Ib (GPIb) is a heterodimeric transmembrane protein consisting of a disulfide-linked 140 kD alpha chain and 22 kD beta chain. It is part of the GPIb-V-IX system that constitutes the receptor for von Willebrand factor (VWF), and mediates platelet adhesion in the arterial circulation. GPIb alpha chain provides the VWF binding site, and GPIb beta contributes to surface expression of the receptor and participates in transmembrane signaling through phosphorylation of its intracellular domain. Mutations in the GPIb beta subunit have been associated with Bernard-Soulier syndrome, velocardiofacial syndrome and giant platelet disorder. The 206 amino acid precursor of GPIb beta is synthesized from a 1.0 kb mRNA expressed in platelets and megakaryocytes. A 411 amino acid protein arising from a longer, unspliced transcript in endothelial cells has been described; however, the authenticity of this product has been questioned. Yet another less abundant GPIb beta mRNA species of 3.5 kb, expressed in nonhematopoietic tissues such as endothelium, brain and heart, was shown to result from inefficient usage of a non-consensus polyA signal in the neighboring upstream gene (SEPT5, septin 5). In the absence of polyadenylation from its own imperfect site, the SEPT5 gene produces read-through transcripts that use the consensus polyA signal of this gene. [provided by RefSeq, Dec 2010]. Sequence Note: This RefSeq record was created from genomic sequence data to make the sequence consistent with the reference genome assembly. The genomic coordinates used for the transcript record were based on transcript alignments. |
| 153 | GPR25 | Y | 2848 | probable G-protein coupled receptor 25 | N/A |
| 154 | GRID2 | N | 2895 | glutamate receptor delta-2 subunit precursor | Human glutamate receptor delta-2 (GRID2) is a relatively new member of the family of ionotropic glutamate receptors which are the predominant excitatory neurotransmitter receptors in the mammalian brain. GRID2 is a predicted 1,007 amino acid protein that shares 97% identity with the mouse homolog which is expressed selectively in cerebellar Purkinje cells. A point mutation in mouse GRID2, associated with the phenotype named 'lurcher', in the heterozygous state leads to ataxia resulting from selective, cell-autonomous apoptosis of cerebellar Purkinje cells during postnatal development. Mice homozygous for this mutation die shortly after birth from massive loss of mid- and hindbrain neurons during late embryogenesis. This strongly suggests a role for GRID2 in neuronal apoptotic death. [provided by RefSeq, Jul 2008]. |
| 155 | GSC2 | Y | 2928 | homeobox protein goosecoid-2 | Goosecoidlike (GSCL), a homeodomain-containing gene, resides in the critical region for VCFS/DGS on 22q11. Velocardiofacial syndrome (VCFS) is a developmental disorder characterized by conotruncal heart defects, craniofacial anomalies, and learning disabilities. VCFS is phenotypically related to DiGeorge syndrome (DGS) and both syndromes are associated with hemizygous 22q11 deletions. Because many of the tissues and structures affected in VCFS/DGS derive from the pharyngeal arches of the developing embryo, it is believed that haploinsufficiency of a gene involved in embryonic development may be responsible for its etiology. The gene is expressed in a limited number of adult tissues, as well as in early human development. [provided by RefSeq, Jul 2008]. Sequence Note: This RefSeq record was created from genomic sequence data because no single transcript was available for the full length of the gene. The extent of this transcript is supported by experimental evidence. |
| 156 | GSTT2 | Y | 2953 | glutathione S-transferase theta-2 | Glutathione S-transferase (GSTs) theta 2 (GSTT2) is a member of a superfamily of proteins that catalyze the conjugation of reduced glutathione to a variety of electrophilic and hydrophobic compounds. Human GSTs can be divided into five main classes: Alpha, Mu, Pi, Theta, and Zeta. The theta class members GSTT1 and GSTT2 share 55% amino acid sequence identity and both are thought to have an important role in human carcinogenesis. The theta genes have a similar structure, being composed of five exons with identical exon/intron boundaries. [provided by RefSeq, Jul 2008]. Publication Note: This RefSeq record includes a subset of the publications that are available for this gene. Please see the Gene record to access additional publications. |
| 157 | GSTT2B | Y | 653689 | glutathione S-transferase theta-2B | N/A |
| 158 | GSTTP2 | Y | 653399 | N/A | N/A |
| 159 | GTF3C4 | Y | 9329 | general transcription factor 3C polypeptide 4 | N/A |
| 160 | GYPA | Y | 2993 | glycophorin-A precursor | Glycophorins A (GYPA) and B (GYPB) are major sialoglycoproteins of the human erythrocyte membrane which bear the antigenic determinants for the MN and Ss blood groups. In addition to the M or N and S or s antigens that commonly occur in all populations, about 40 related variant phenotypes have been identified. These variants include all the variants of the Miltenberger complex and several isoforms of Sta, as well as Dantu, Sat, He, Mg, and deletion variants Ena, S-s-U- and Mk. Most of the variants are the result of gene recombinations between GYPA and GYPB. [provided by RefSeq, Jul 2008]. Sequence Note: This RefSeq record was created from transcript and genomic sequence data to make the sequence |

TABLE 3-continued

| Gene Number | Gene Name | Exon overlap | NCBI Gene ID | Gene Description | RefSeq Summmary |
|---|---|---|---|---|---|
| | | | | | consistent with the reference genome assembly. The genomic coordinates used for the transcript record were based on transcript alignments. Sequence Note: This RefSeq record represents the GYPA*0010101 allele. |
| 161 | HACL1 | Y | 26061 | 2-hydroxyacyl-CoA lyase 1 | N/A |
| 162 | HAR1A | Y | 768096 | N/A | N/A |
| 163 | HAR1B | Y | 768097 | N/A | N/A |
| 164 | HBG1 | Y | 3047 | hemoglobin subunit gamma-1 | The gamma globin genes (HBG1 and HBG2) are normally expressed in the fetal liver, spleen and bone marrow. Two gamma chains together with two alpha chains constitute fetal hemoglobin (HbF) which is normally replaced by adult hemoglobin (HbA) at birth. In some beta-thalassemias and related conditions, gamma chain production continues into adulthood. The two types of gamma chains differ at residue 136 where glycine is found in the G-gamma product (HBG2) and alanine is found in the A-gamma product (HBG1). The former is predominant at birth. The order of the genes in the beta-globin cluster is: 5'-epsilon gamma-G -- gamma-A-- delta -- beta--3'. [provided by RefSeq, Jul 2008]. |
| 165 | HEATR4 | N | 399671 | HEAT repeat-containing protein 4 | N/A |
| 166 | HERC2P2 | Y | 400322 | N/A | N/A |
| 167 | HERC2P7 | Y | 100132101 | N/A | N/A |
| 168 | HERV-VI | Y | N/A | N/A | N/A |
| 169 | HHATL | Y | 57467 | N/A | N/A |
| 170 | HIRA | Y | 7920 | protein HIRA | This gene encodes a histone chaperone that preferentially places the variant histone H3.3 in nucleosomes. Orthologs of this gene in yeast, flies, and plants are necessary for the formation of transcriptionally silent heterochromatin. This gene plays an important role in the formation of the senescence-associated heterochromatin foci. These foci likely mediate the irreversible cell cycle changes that occur in senescent cells. It is considered the primary candidate gene in some haploinsufficiency syndromes such as DiGeorge syndrome, and insufficient production of the gene may disrupt normal embryonic development. [provided by RefSeq, Jul 2008]. |
| 171 | HIRIP3 | Y | 8479 | HIRA-interacting protein 3 isoform 2 | The HIRA protein shares sequence similarity with Hirlp and Hir2p, the two corepressors of histone gene transcription characterized in the yeast, Saccharomyces cerevisiae. The structural features of the HIRA protein suggest that it may function as part of a multiprotein complex. Several cDNAs encoding HIRA-interacting proteins, or HIRIPs, have been identified. In vitro, the protein encoded by this gene binds HIRA, as well as H2B and H3 core histones, indicating that a complex containing HIRA-HIRIP3 could function in some aspects of chromatin and histone metabolism. Alternatively spliced transcript variants encoding distinct isoforms have been found for this gene.[provided by RefSeq, Aug 2011]. Transcript Variant: This variant (2) lacks an exon in the coding region, resulting in frame-shift, compared to variant 1. The resulting isoform (2) is shorter and has a distinct C-terminus, compared to isoform 1. |
| 172 | HIST2H2AA3 | Y | 8337 | histone H2A type 2-A | Histones are basic nuclear proteins that are responsible for the nucleosome structure of the chromosomal fiber in eukaryotes. Two molecules of each of the four core histones (H2A, H2B, H3, and H4) form an octamer, around which approximately 146 bp of DNA is wrapped in repeating units, called nucleosomes. The linker histone, H1, interacts with linker DNA between nucleosomes and functions in the compaction of chromatin into higher order structures. Transcripts from this gene lack polyA tails but instead contain a palindromic termination element. This gene is found in a histone cluster on chromosome 1. This gene is one of four histone genes in the cluster that are duplicated; this record represents the centromeric copy. [provided by RefSeq, Jul 2008]. |
| 173 | HIST2H2AA4 | Y | 723790 | histone H2A type 2-A | Histones are basic nuclear proteins that are responsible for the nucleosome structure of the chromosomal fiber in eukaryotes. Two molecules of each of the four core histones (H2A, H2B, H3, and H4) form an octamer, around which approximately 146 bp of DNA is wrapped in repeating units, called nucleosomes. The linker histone, H1, interacts with linker DNA between nucleosomes and functions in the compaction of chromatin into higher order structures. Transcripts from this gene lack polyA tails but instead contain a palindromic termination element. This gene is found in a histone cluster on chromosome 1. This gene is one of four histone genes in the cluster that are duplicated; this record represents the telomeric copy. [provided by RefSeq, Jul 2008]. Sequence Note: The RefSeq transcript was derived from the reference genome assembly. The genomic coordinates used for the transcript record were based on transcript alignments. |
| 174 | HIST2H2BF | Y | 440689 | histone H2B type 2-F isoform b | N/A |

TABLE 3-continued

| Gene Number | Gene Name | Exon overlap | NCBI Gene ID | Gene Description | RefSeq Summmary |
|---|---|---|---|---|---|
| 175 | HIST2H3A | Y | 333932 | histone H3.2 | Histones are basic nuclear proteins that are responsible for the nucleosome structure of the chromosomal fiber in eukaryotes. This structure consists of approximately 146 bp of DNA wrapped around a nucleosome, an octamer composed of pairs of each of the four core histones (H2A, H2B, H3, and H4). The chromatin fiber is further compacted through the interaction of a linker histone, H1, with the DNA between the nucleosomes to form higher order chromatin structures. This gene is intronless and encodes a member of the histone H3 family. Transcripts from this gene lack polyA tails; instead, they contain a palindromic termination element. This gene is found in a histone cluster on chromosome 1. This gene is one of four histone genes in the cluster that are duplicated; this record represents the centromeric copy. [provided by RefSeq, Jul 2008]. |
| 176 | HIST2H3C | Y | 126961 | histone H3.2 | Histones are basic nuclear proteins that are responsible for the nucleosome structure of the chromosomal fiber in eukaryotes. This structure consists of approximately 146 bp of DNA wrapped around a nucleosome, an octamer composed of pairs of each of the four core histones (H2A, H2B, H3, and H4). The chromatin fiber is further compacted through the interaction of a linker histone, H1, with the DNA between the nucleosomes to form higher order chromatin structures. This gene is intronless and encodes a member of the histone H3 family. Transcripts from this gene lack polyA tails; instead, they contain a palindromic termination element. This gene is found in a histone cluster on chromosome 1. This gene is one of four histone genes in the cluster that are duplicated; this record represents the telomeric copy. [provided by RefSeq, Jul 2008]. |
| 177 | HIST2H3D | Y | 653604 | histone H3.2 | N/A |
| 178 | HIST2H4A | Y | 8370 | histone H4 | Histones are basic nuclear proteins that are responsible for the nucleosome structure of the chromosomal fiber in eukaryotes. This structure consists of approximately 146 bp of DNA wrapped around a nucleosome, an octamer composed of pairs of each of the four core histones (H2A, H2B, H3, and H4). The chromatin fiber is further compacted through the interaction of a linker histone, H1, with the DNA between the nucleosomes to form higher order chromatin structures. This gene is intronless and encodes a member of the histone H4 family. Transcripts from this gene lack polyA tails; instead, they contain a palindromic termination element. This gene is found in a histone cluster on chromosome 1. This gene is one of four histone genes in the cluster that are duplicated; this record represents the centromeric copy. [provided by RefSeq, Jul 2008]. |
| 179 | HIST2H4B | Y | 554313 | histone H4 | Histones are basic nuclear proteins that are responsible for the nucleosome structure of the chromosomal fiber in eukaryotes. This structure consists of approximately 146 bp of DNA wrapped around a nucleosome, an octamer composed of pairs of each of the four core histones (H2A, H2B, H3, and H4). The chromatin fiber is further compacted through the interaction of a linker histone, H1, with the DNA between the nucleosomes to form higher order chromatin structures. This gene is intronless and encodes a member of the histone H4 family. Transcripts from this gene lack polyA tails; instead, they contain a palindromic termination element. This gene is found in a histone cluster on chromosome 1. This gene is one of four histone genes in the cluster that are duplicated; this record represents the telomeric copy. [provided by RefSeq, Jul 2008]. |
| 180 | HKR1 | N | 284459 | Krueppel-related zinc finger protein 1 | N/A |
| 181 | HMX1 | both | 3166 | homeobox protein HMX1 | This gene encodes a transcription factor that belongs to the H6 family of homeobox proteins. This protein can bind a 5'-CAAG-3' core DNA sequence, and it is involved in the development of craniofacial structures. Mutations in this gene cause oculoauricular syndrome, a disorder of the eye and external ear. [provided by RefSeq, Oct 2009]. Sequence Note: The RefSeq transcript and protein were derived from genomic sequence to make the sequence consistent with the reference genome assembly. The genomic coordinates used for the transcript record were based on transcript alignments. |
| 182 | HPR | Y | 3250 | haptoglobin-related protein precursor | This gene encodes a haptoglobin-related protein that binds hemoglobin as efficiently as haptoglobin. Unlike haptoglobin, plasma concentration of this protein is unaffected in patients with sickle cell anemia and extensive intravascular hemolysis, suggesting a difference in binding between haptoglobin-hemoglobin and haptoglobin-related protein-hemoglobin complexes to CD163, the hemoglobin scavenger receptor. This protein may also be a clinically important predictor of recurrence of breast cancer. [provided by RefSeq, Oct 2011]. |
| 183 | HTR4 | N | 3360 | 5-hydroxytryptamine receptor 4 isoform i | This gene is a member of the family of serotonin receptors, which are G protein coupled receptors that stimulate cAMP production in response to serotonin (5-hydroxytryptamine). The gene product is a glycosylated transmembrane protein that functions in both the peripheral and central nervous system to modulate the release of various neurotransmitters. Multiple |

TABLE 3-continued

| Gene Number | Gene Name | Exon overlap | NCBI Gene ID | Gene Description | RefSeq Summmary |
|---|---|---|---|---|---|
| | | | | | transcript variants encoding proteins with distinct C-terminal sequences have been described. [provided by RefSeq, May 2010]. Transcript Variant: This variant (i) differs in the 5' UTR and includes an alternate in-frame exon, compared to variant b. This results in a longer protein (isoform i), compared to isoform b. |
| 184 | IFNA22P | Y | 3453 | N/A | N/A |
| 185 | IL27RA | Y | 9466 | interleukin-27 receptor subunit alpha precursor | In mice, CD4+ helper T-cells differentiate into type 1 (Th1) cells, which are critical for cell-mediated immunity, predominantly under the influence of IL12. Also, IL4 influences their differentiation into type 2 (Th2) cells, which are critical for most antibody responses. Mice deficient in these cytokines, their receptors, or associated transcription factors have impaired, but not absent of, Th1 or Th2 immune responses. This gene encodes a protein which is similar to the mouse T-cell cytokine receptor Tccr at the amino acid level, and is predicted to be a glycosylated transmembrane protein. [provided by RefSeq, Jul 2008]. |
| 186 | INO80E | Y | 283899 | INO80 complex subunit E | N/A |
| 187 | INTS2 | N | 57508 | integrator complex subunit 2 | INTS2 is a subunit of the Integrator complex, which associates with the C-terminal domain of RNA polymerase II large subunit (POLR2A; MIM 180660) and mediates 3-prime end processing of small nuclear RNAs U1 (RNU1; MIM 180680) and U2 (RNU2; MIM 180690) (Baillat et al., 2005 [PubMed 16239144]).[supplied by OMIM, Mar 2008]. Transcript Variant: This variant (1) is the protein-coding variant. Sequence Note: This RefSeq record was created from transcript and genomic sequence data because no single transcript was available for the full length of the gene. The extent of this transcript is supported by transcript alignments. |
| 188 | IRGM | Y | 345611 | immunity-related GTPase family M protein | This gene encodes a member of the p47 immunity-related GTPase family. The encoded protein may play a role in the innate immune response by regulating autophagy formation in response to intracellular pathogens. Polymorphisms that affect the normal expression of this gene are associated with a susceptibility to Crohn's disease and tuberculosis.[provided by RefSeq, Oct 2010]. Sequence Note: The RefSeq transcript and protein were derived from genomic sequence to make the sequence consistent with the reference genome assembly. The genomic coordinates used for the transcript record were based on alignments. |
| 189 | ITGBL1 | N | 9358 | integrin beta-like protein 1 precursor | N/A |
| 190 | JAG2 | Y | 3714 | protein jagged-2 isoform b precursor | The Notch signaling pathway is an intercellular signaling mechanism that is essential for proper embryonic development. Members of the Notch gene family encode transmembrane receptors that are critical for various cell fate decisions. The protein encoded by this gene is one of several ligands that activate Notch and related receptors. Two transcript variants encoding different isoforms have been found for this gene. [provided by RefSeq, Jul 2008]. Transcript Variant: This variant (2) lacks an alternate in-frame exon compared to variant 1, resulting in a shorter protein (isoform b) than isoform a encoded by variant 1. Isoform b is also known as hJAG2.del-E6. |
| 191 | KCTD13 | Y | 253980 | BTB/POZ domain-containing adapter for CUL3-mediated RhoA degradation protein 1 | N/A |
| 192 | KIAA1217 | Y | 56243 | sickle tail protein homolog isoform 3 | N/A |
| 193 | KIA1267 | N | 284058 | MLL1/MLL complex subunit KIAA1267 isoform 1 | N/A |
| 194 | KLHL3 | N | 26249 | kelch-like protein 3 | N/A |
| 195 | KRT39 | Y | 390792 | keratin, type I cytoskeletal 39 | This gene encodes a member of the type I (acidic) keratin family, which belongs to the superfamily of intermediate filament (IF) proteins. Keratins are heteropolymeric structural proteins which form the intermediate filament. These filaments, along with actin microfilaments and microtubules, compose the cytoskeleton of epithelial cells. The type I keratin genes are clustered in a region of chromosome 17q12-q21. [provided by RefSeq, Jul 2009]. |
| 196 | KRT40 | Y | 125115 | keratin, type I cytoskeletal 40 | This gene encodes a member of the type I (acidic) keratin family, which belongs to the superfamily of intermediate filament (IF) proteins. Keratins are heteropolymeric structural proteins which form the intermediate filament. These filaments, along with actin microfilaments and microtubules, compose the cytoskeleton of epithelial cells. The type I keratin genes are clustered in a region of chromosome 17q12-q21. [provided by RefSeq, Jul 2009]. Sequence Note: The |

TABLE 3-continued

| Gene Number | Gene Name | Exon overlap | NCBI Gene ID | Gene Description | RefSeq Summary |
|---|---|---|---|---|---|
| | | | | | RefSeq transcript and protein were derived from genomic sequence to make the sequence consistent with the reference genome assembly. The genomic coordinates used for the transcript record were based on alignments. |
| 197 | KRTAP1-1 | Y | 81851 | keratin-associated protein 1-1 | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the high sulfur KAP family and the gene is localized to a cluster of KAPs at 17q12-q21. [provided by RefSeq, Jul 2008]. |
| 198 | KRTAP1-3 | Y | 81850 | keratin-associated protein 1-3 | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the high sulfur KAP family and the gene is localized to a cluster of KAPs at 17q12-q21. [provided by RefSeq, Jul 2008]. |
| 199 | KRTAP1-5 | Y | 83895 | keratin-associated protein 1-5 | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the high sulfur KAP family and the gene is localized to a cluster of KAPs at 17q12-q21. [provided by RefSeq, Jul 2008]. |
| 200 | KRTAP2-1 | Y | 81872 | keratin-associated protein 2-1 | N/A |
| 201 | KRTAP2-2 | Y | 728279 | keratin associated protein 2-2 | N/A |
| 202 | KRTAP2-4 | Y | 85294 | keratin-associated protein 2-4 | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the high sulfur KAP family and the gene is localized to a cluster of KAPs at 17q12-q21. [provided by RefSeq, Jul 2008]. |
| 203 | KRTAP3-1 | Y | 83896 | keratin-associated protein 3-1 | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the high sulfur KAP family and the gene is localized to a cluster of KAPs at 17q12-q21. [provided by RefSeq, Jul 2008]. |
| 204 | KRTAP3-2 | Y | 83897 | keratin-associated protein 3-2 | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the high sulfur KAP family and the gene is localized to a cluster of KAPs at 17q12-q21. [provided by RefSeq, Jul 2008]. |
| 205 | KRTAP3-3 | Y | 85293 | keratin-associated protein 3-3 | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the high sulfur KAP family and the gene is localized to a cluster of KAPs at 17q12-q21. [provided by RefSeq, Jul 2008]. |
| 206 | KRTAP4-11 | Y | 653240 | keratin-associated protein 4-11 | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the ultrahigh sulfur KAP family and the gene is localized to a cluster of KAPs at 17q12-q21. [provided by RefSeq, Mar 2009]. Sequence Note: The RefSeq transcript and protein were derived from genomic sequence to make the sequence consistent with the reference genome assembly. The genomic coordinates used for the transcript record were based on alignments. |
| 207 | KRTAP4-12 | Y | 83755 | keratin-associated protein 4-12 | This protein is a member of the keratin-associated protein (KAP) family. The KAP proteins form a matrix of keratin intermediate filaments which contribute to the structure of hair fibers. KAP family members appear to have unique, |

TABLE 3-continued

| Gene Number | Gene Name | Exon overlap | NCBI Gene ID | Gene Description | RefSeq Summmary |
|---|---|---|---|---|---|
| 208 | L1CAM | Y | 3897 | neural cell adhesion molecule L1 isoform 3 precursor | family-specific amino- and carboxyl-terminal regions and are subdivided into three multi-gene families according to amino acid composition: the high sulfur, the ultrahigh sulfur, and the high tyrosine/glycine KAPs. This protein is a member of the ultrahigh sulfur KAP family and the gene is localized to a cluster of KAPs at 17q12-q21. [provided by RefSeq, Jul 2008]. The protein encoded by this gene is an axonal glycoprotein belonging to the immunoglobulin supergene family. The ectodomain, consisting of several immunoglobulin-like domains and fibronectin-like repeats (type III), is linked via a single transmembrane sequence to a conserved cytoplasmic domain. This cell adhesion molecule plays an important role in nervous system development, including neuronal migration and differentiation. Mutations in the gene cause three X-linked neurological syndromes known by the acronym CRASH (corpus callosum hypoplasia, retardation, aphasia, spastic paraplegia and hydrocephalus). Alternative splicing of a neuron-specific exon is thought to be functionally relevant. [provided by RefSeq, Jul 2008]. Transcript Variant: This variant (3) lacks an internal exon in the 5 region and a neuron-specific exon in the 3' region, as compared to variant 1. The resulting isoform (3) is shorter, and lacks an internal segment in the N-terminus and is missing a tyrosine-based sorting motif in the C-terminus. |
| 209 | LAMC2 | N | 3918 | laminin subunit gamma-2 isoform b precursor | Laminins, a family of extracellular matrix glycoproteins, are the major noncollagenous constituent of basement membranes. They have been implicated in a wide variety of biological processes including cell adhesion, differentiation, migration, signaling, neurite outgrowth and metastasis. Laminins, composed of 3 non identical chains: laminin alpha, beta and gamma (formerly A, B1, and B2, respectively), have a cruciform structure consisting of 3 short arms, each formed by a different chain, and a long arm composed of all 3 chains. Each laminin chain is a multidomain protein encoded by a distinct gene. Several isoforms of each chain have been described. Different alpha, beta and gamma chain isomers combine to give rise to different heterotrimeric laminin isoforms which are designated by Arabic numerals in the order of their discovery, i.e. alphabetalgammal heterotrimer is laminin 1. The biological functions of the different chains and trimer molecules are largely unknown, but some of the chains have been shown to differ with respect to their tissue distribution, presumably reflecting diverse functions in vivo. This gene encodes the gamma chain isoform laminin, gamma 2. The gamma 2 chain, formerly thought to be a truncated version of beta chain (B2t), is highly homologous to the gamma 1 chain; however, it lacks domain VI, and domains V, IV and III are shorter. It is expressed in several fetal tissues but differently from gamma 1, and is specifically localized to epithelial cells in skin, lung and kidney. The gamma 2 chain together with alpha 3 and beta 3 chains constitute laminin 5 (earlier known as kalinin), which is an integral part of the anchoring filaments that connect epithelial cells to the underlying basement membrane. The epithelium-specific expression of the gamma 2 chain implied its role as an epithelium attachment molecule, and mutations in this gene have been associated with junctional epidermolysis bullosa, a skin disease characterized by blisters due to disruption of the epidermal-dermal junction. Two transcript variants resulting from alternative splicing of the 3' terminal exon, and encoding different isoforms of gamma 2 chain, have been described. The two variants are differentially expressed in embryonic tissues, however, the biological significance of the two forms is not known. Transcript variants utilizing alternative polyA signal have also been noted in literature. [provided by RefSeq, Aug 2011]. Transcript Variant: This variant (2) represents a shorter transcript variant, compared to variant 1, and encodes a shorter isoform (b). Transcript variant 2, unlike variant 1, has limited expression only in the embryonic cerebral cortex, lung and distal tubules of the kidney. Sequence Note: This RefSeq record was created from transcript and genomic sequence data because transcript sequence consistent with the reference genome assembly was not available for all regions of the RefSeq transcript. The extent of this transcript is supported by transcript alignments. |
| 210 | LARP4B | N | 23185 | la-related protein 4B | N/A |
| 211 | LCE3D | Y | 84648 | late cornified envelope protein 3D | N/A |
| 212 | LCE3E | Y | 353145 | late cornified envelope protein 3E | N/A |
| 213 | LCP1 | N | 3936 | plastin-2 | Plastins are a family of actin-binding proteins that are conserved throughout eukaryote evolution and expressed in most tissues of higher eukaryotes. In humans, two ubiquitous plastin isoforms (L and T) have been identified. Plastin 1 (otherwise known as Fimbrin) is a third distinct plastin isoform which is specifically expressed at high levels in the small intestine. The L isoform is expressed only in hemopoietic cell lineages, while the T isoform has been found in all other normal cells of solid tissues that have replicative potential (fibroblasts, endothelial cells, epithelial cells, melanocytes, etc.). However, L-plastin has been found in many types of malignant human cells of non-hemopoietic origin suggesting that its expression is induced accompanying tumorigenesis in solid tissues. [provided by RefSeq, Jul 2008]. Publication Note: This |

TABLE 3-continued

| Gene Number | Gene Name | Exon overlap | NCBI Gene ID | Gene Description | RefSeq Summmary |
|---|---|---|---|---|---|
| | | | | | RefSeq record includes a subset of the publications that are available for this gene. Please see the Gene record to access additional publications. |
| 214 | LILRB3 | Y | 11025 | leukocyte immunoglobulin-like receptor subfamily B member 3 isoform 1 precursor | This gene is a member of the leukocyte immunoglobulin-like receptor (LIR) family, which is found in a gene cluster at chromosomal region 19q13.4. The encoded protein belongs to the subfamily B class of LIR receptors which contain two or four extracellular immunoglobulin domains, a transmembrane domain, and two to four cytoplasmic immunoreceptor tyrosine-based inhibitory motifs (ITIMs). The receptor is expressed on immune cells where it binds to MHC class I molecules on antigen-presenting cells and transduces a negative signal that inhibits stimulation of an immune response. It is thought to control inflammatory responses and cytotoxicity to help focus the immune response and limit autoreactivity. Multiple transcript variants encoding different isoforms have been found for this gene. [provided by RefSeq, Jul 2008]. Transcript Variant: This variant (1) represents the longer transcript and encodes the longer isoform (1). |
| 215 | LILRB4 | Y | 11006 | leukocyte immunoglobulin-like receptor subfamily B member 4 isoform 2 precursor | This gene is a member of the leukocyte immunoglobulin-like receptor (LIR) family, which is found in a gene cluster at chromosomal region 19q13.4. The encoded protein belongs to the subfamily B class of LIR receptors which contain two or four extracellular immunoglobulin domains, a transmembrane domain, and two to four cytoplasmic immunoreceptor tyrosine-based inhibitory motifs (ITIMs). The receptor is expressed on immune cells where it binds to MHC class I molecules on antigen-presenting cells and transduces a negative signal that inhibits stimulation of an immune response. The receptor can also function in antigen capture and presentation. It is thought to control inflammatory responses and cytotoxicity to help focus the immune response and limit autoreactivity. Multiple transcript variants encoding different isoforms have been found for this gene. [provided by RefSeq, Jul 2008]. Transcript Variant: This variant (2) uses an alternate in-frame splice site in the 3 coding region, compared to variant 1, resulting in a protein (isoform 2) that is 1 aa shorter than isoform 1. |
| 216 | LIN7A | N | 8825 | protein lin-7 homolog A | N/A |
| 217 | LINGO2 | N | 158038 | leucine-rich repeat and immunoglobulin-like domain-containing nogo receptor-interacting protein 2 precursor | N/A |
| 218 | LOC100129827 | Y | N/A | N/A | N/A |
| 219 | LOC100272228 | Y | 100272228 | N/A | N/A |
| 220 | LOC100287704 | Y | 100287704 | N/A | N/A |
| 221 | LOC100287834 | Y | 100287834 | N/A | N/A |
| 222 | LOC150185 | Y | 150185 | N/A | N/A |
| 223 | LOC150776 | Y | 150776 | N/A | N/A |
| 224 | LOC283922 | Y | 283922 | N/A | N/A |
| 225 | LOC284551 | Y | 284551 | N/A | N/A |
| 226 | LOC286467 | Y | 286467 | N/A | N/A |
| 227 | LOC342346 | Y | N/A | N/A | N/A |
| 228 | LOC401164 | Y | 401164 | N/A | N/A |
| 229 | LOC401431 | Y | 401431 | N/A | N/A |
| 230 | LOC401588 | Y | 401588 | N/A | N/A |
| 231 | LOC440297 | Y | 440297 | N/A | N/A |
| 232 | LOC440356 | Y | 440356 | N/A | N/A |
| 233 | LOC441495 | Y | 441495 | N/A | N/A |
| 234 | LOC63930 | N | 63930 | N/A | N/A |
| 235 | LOC63930 | Y | 63930 | N/A | N/A |
| 236 | LOC643837 | Y | 643837 | N/A | N/A |
| 237 | LOC643955 | Y | 643955 | N/A | N/A |
| 238 | LOC653513 | Y | 653513 | N/A | N/A |
| 239 | LOC727849 | Y | 727849 | N/A | N/A |
| 240 | LOC728855 | Y | 728855 | N/A | N/A |
| 241 | LOC728875 | Y | 728875 | N/A | N/A |

TABLE 3-continued

| Gene Number | Gene Name | Exon overlap | NCBI Gene ID | Gene Description | RefSeq Summmary |
|---|---|---|---|---|---|
| 242 | LOC729513 | Y | 729513 | N/A | N/A |
| 243 | LOC729678 | Y | 729678 | N/A | N/A |
| 244 | LOC730755 | Y | 730755 | keratin associated protein 2-4-like | N/A |
| 245 | LOC80154 | Y | N/A | N/A | N/A |
| 246 | LOC92249 | Y | 92249 | N/A | N/A |
| 247 | LOC92659 | Y | 92659 | N/A | N/A |
| 248 | LOH12CR1 | N | 118426 | loss of heterozygosity 12 chromosomal region 1 protein | N/A |
| 249 | LRRC49 | N | 54839 | leucine-rich repeat-containing protein 49 isoform 49 | N/A |
| 250 | LRRTM4 | N | 80059 | leucine-rich repeat transmembrane neuronal protein 4 isoform a | N/A |
| 251 | LSAMP | N | 4045 | limbic system-associated membrane protein preproprotein | The protein encoded by this gene is a neuronal surface glycoprotein found in cortical and subcortical regions of the limbic system. During development of the limbic system, this encoded protein is found on the surface of axonal membranes and growth cones, where it acts as a selective homophilic adhesion molecule, and guides the development of specific patterns of neuronal connections. [provided by RefSeq, Jul 2008]. Sequence Note: This RefSeq record was created from transcript and genomic sequence data to make the sequence consistent with the reference genome assembly. The genomic coordinates used for the transcript record were based on transcript alignments. |
| 252 | LYPD6 | N | 130574 | ly6/PLAUR domain-containing protein 6 precursor | Members of the LY6 protein family (see SLURP1; MIM 606119), such as LYPD6, have at least one 80-amino acid LU domain that contains 10 conserved cysteines with a defined disulfide-bonding pattern (Zhang et al., 2010 [PubMed 19653121]).[supplied by OMIM, Apr 2010]. Transcript Variant: This variant (1) represents the longer transcript. Variants 1 and 2 encode the same protein. |
| 253 | LYVE1 | Y | 10894 | lymphatic vessel endothelial hyaluronic acid receptor 1 precursor | This gene encodes a type I integral membrane glycoprotein. The encoded protein acts as a receptor and binds to both soluble and immobilized hyaluronan. This protein may function in lymphatic hyaluronan transport and have a role in tumor metastasis. [provided by RefSeq, Jul 2008]. |
| 254 | MAGEA11 | Y | 4110 | melanoma-associated antigen 11 isoform b | This gene is a member of the MAGEA gene family. The members of this family encode proteins with 50 to 80% sequence identity to each other. The promoters and first exons of the MAGEA genes show considerable variability, suggesting that the existence of this gene family enables the same function to be expressed under different transcriptional controls. The MAGEA genes are clustered at chromosomal location Xq28. They have been implicated in some hereditary disorders, such as dyskeratosis congenita. Two transcript variants encoding different isoforms have been found for this gene. [provided by RefSeq, Jul 2008]. Transcript Variant: This variant (2) differs in the 5 UTR and CDS compared to variant 1. The resulting isoform (b) is shorter and has a distinct N-terminus compared to isoform a. Publication Note: This RefSeq record includes a subset of the publications that are available for this gene. Please see the Gene record to access additional publications. |
| 255 | MAGEC1 | Y | 9947 | melanoma-associated antigen C1 | This gene is a member of the melanoma antigen gene (MAGE) family. The proteins of this family are tumor-specific antigens that can be recognized by autologous cytolytic T lymphocytes. This protein contains a large number of unique short repetitive sequences in front of the MAGE-homologous sequence, and therefore is about 800 aa longer than the other MAGE proteins. [provided by RefSeq, Jul 2008]. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| 256 | MAGEC3 | Y | 139081 | melanoma-associated antigen C3 isoform 1 | This gene is a member of the MAGEC gene family. The members of this family are not expressed in normal tissues, except for testis, and are expressed in tumors of various histological types. The MAGEC genes are clustered on chromosome Xq26-q27. Two transcript variants encoding distinct isoforms have been found for this gene. [provided by RefSeq, Jul 2008]. Transcript Variant: This variant (1) is the longer transcript and encodes the longer isoform (1). |

TABLE 3-continued

| Gene Number | Gene Name | Exon overlap | NCBI Gene ID | Gene Description | RefSeq Summmary |
|---|---|---|---|---|---|
| 257 | MAGI3 | N | 260425 | membrane-associated guanylate kinase, WW and PDZ domain-containing protein 3 isoform 1 | N/A |
| 258 | MAGT1 | Y | 84061 | magnesium transporter protein 1 | This gene encodes a magnesium cation transporter protein that localizes to the cell membrane. This protein also associates with N-oligosaccharyl transferase and therefore may have a role in N-glycosylation. Mutations in this gene cause mental retardation X-linked type 95 (MRX95). This gene may have multiple in-frame translation initiation sites, one of which would encode a shorter protein with an N-terminus containing a signal peptide at amino acids 1-29. [provided by RefSeq, Jan 2010]. |
| 259 | MAZ | Y | 4150 | myc-associated zinc finger protein isoform 1 | N/A |
| 260 | MCART6 | Y | 401612 | mitochondrial carrier triple repeat protein 6 | N/A |
| 261 | MCF2L | Y | 23263 | guanine nucleotide exchange factor DBS isoform a | N/A |
| 262 | MCM5 | Y | 4174 | DNA replication licensing factor MCM5 | The protein encoded by this gene is structurally very similar to the CDC46 protein from S. cerevisiae, a protein involved in the initiation of DNA replication. The encoded protein is a member of the MCM family of chromatin-binding proteins and can interact with at least two other members of this family. The encoded protein is upregulated in the transition from the G0 to G1/S phase of the cell cycle and may actively participate in cell cycle regulation. [provided by RefSeq, Jul 2008]. |
| 263 | MDGA2 | N | 161357 | MAM domain-containing glycosylphosphatidylinositol anchor protein 2 isoform 1 | N/A |
| 264 | MEIG1 | Y | 644890 | meiosis expressed gene 1 protein homolog | N/A |
| 265 | MGAM | Y | 8972 | maltase-glucoamylase, intestinal | This gene encodes maltase-glucoamylase, which is a brush border membrane enzyme that plays a role in the final steps of digestion of starch. The protein has two catalytic sites identical to those of sucrase-isomaltase, but the proteins are only 59% homologous. Both are members of glycosyl hydrolase family 31, which has a variety of substrate specificities. [provided by RefSeq, Jul 2008]. |
| 266 | MIDN | Y | 90007 | midnolin | N/A |
| 267 | MIR1233-1 | Y | 100302160 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5 and 3' ends may not be included in the intermediate precursor miRNA produced by Drosha cleavage. |
| 268 | MIR1233-2 | Y | 100422845 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base |

TABLE 3-continued

| Gene Number | Gene Name | Exon overlap | NCBI Gene ID | Gene Description | RefSeq Summmary |
|---|---|---|---|---|---|
| | | | | | pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| 269 | MIR1306 | Y | 100302197 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| 270 | MIR185 | Y | 406961 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| 271 | MIR208B | Y | 100126336 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| 272 | MIR3618 | Y | 100500860 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5 and 3' ends may not be included in the intermediate precursor miRNA produced by Drosha cleavage. |
| 273 | MIR516B2 | Y | 574485 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by |

TABLE 3-continued

| Gene Number | Gene Name | Exon overlap | NCBI Gene ID | Gene Description | RefSeq Summmary |
|---|---|---|---|---|---|
| | | | | | RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record included in the intermediate precursor miRNA produced by Drosha cleavage. |
| 274 | MIR518A1 | Y | 574488 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop as defined by miRBase. Some sequence at the 5' and 3' ends may not be included in the intermediate precursor miRNA produced by Drosha cleavage. |
| 275 | MIR518 | Y | 574487 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop as defined by miRBase. Some sequence at the 5' and 3' ends may not be included in the intermediate precursor miRNA produced by Drosha cleavage. |
| 276 | MIR526A2 | Y | 57486 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop as defined by miRBase. Some sequence at the 5' and 3' ends may not be included in the intermediate precursor miRNA produced by Drosha cleavage. |
| 277 | MIR662 | Y | 724032 | N/A | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The |

TABLE 3-continued

| Gene Number | Gene Name | Exon overlap | NCBI Gene ID | Gene Description | RefSeq Summary |
|---|---|---|---|---|---|
| 278 | MIR890 | Y | 100126303 | N/A | RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, Sep 2009]. Sequence Note: This record represents a predicted microRNA stem-loop as defined by miRBase. Some sequence at the 5' and 3' ends may not be included in the intermediate precursor miRNA produced by Drosha cleavage. |
| 279 | MOXD1 | N | 26002 | DBH-like monooxygenase protein 1 isoform 2 | N/A |
| 280 | MRPL40 | Y | 64976 | 39S ribosomal protein L40, mitochondrial precursor | Mammalian mitochondrial ribosomal proteins are encoded by nuclear genes and help in protein synthesis within the mitochondrion. Mitochondrial ribosomes (mitoribosomes) consist of a small 28S subunit and a large 39S subunit. They have an estimated 75% protein to rRNA composition compared to prokaryotic ribosomes, where this ratio is reversed. Another difference between mammalian mitoribosomes and prokaryotic ribosomes is that the latter contain a 5S rRNA. Among different species, the proteins comprising the mitoribosome differ greatly in sequence, and sometimes in biochemical properties, which prevents easy recognition by sequence homology. This gene encodes a 39S subunit protein. Deletions in this gene may contribute to the etiology of velo-cardio-facial syndrome and DiGeorge syndrome. [provided by RefSeq, Jul 2008]. |
| 281 | MRVI1 | Y | 10335 | protein MRVI1 isoform b | This gene is similar to a putative mouse tumor suppressor gene (Mrvi) that is frequently disrupted by mouse AIDS-related virus (MRV). The encoded protein, which is found in the membrane of the endoplasmic reticulum, is similar to Jaw1, a lymphoid-restricted protein whose expression is down-regulated during lymphoid differentiation. This protein is a substrate of cGMP-dependent kinase-1 (PKG1) that can function as a regulator of IP3-induced calcium release. Studies in mouse suggest that MRV integration at Mrvi1 induces myeloid leukemia by altering the expression of a gene important for myeloid cell growth and/or differentiation, and thus this gene may function as a myeloid leukemia tumor suppressor gene. Several alternatively spliced transcript variants encoding different isoforms have been found for this gene, and alternative translation start sites, including a non-AUG (CUG) start site, are used. [provided by RefSeq, May 2011]. Transcript Variant: This variant (3) differs in the 5' UTR, lacks a portion of the 5' coding region, initiates translation from an downstream in-frame non-AUG (CUG) start codon, and uses an alternate in-frame splice site in the central coding region, compared to variant 1. The encoded isoform (b, also known as MRVI1B) is shorter at the N-terminus, compared to isoform a. Sequence Note: This RefSeq record was created from transcript and genomic sequence data to make the sequence consistent with the reference genome assembly. The genomic coordinates used for the transcript record were based on transcript alignments. |
| 282 | MSLNL | Y | 401827 | mesothelin-like protein | N/A |
| 283 | MTRNR2L1 | Y | 100462977 | humanin-like protein 1 | N/A |
| 284 | MTRNR2L4 | Y | 100463285 | humanin-like protein 4 | N/A |
| 285 | MTRNR2L5 | Y | 100463289 | humanin-like protein 5 | N/A |
| 286 | MTRNR2L8 | Y | 100463486 | humanin-like protein 8 | N/A |
| 287 | MTUS1 | Y | 57509 | microtubule-associated tumor suppressor 1 isoform 5 | This gene encodes a protein which contains a C-terminal domain able to interact with the angiotension II (AT2) receptor and a large coiled-coil region allowing dimerization. Multiple alternatively spliced transcript variants encoding different isoforms have been found for this gene. One of the transcript variants has been shown to encode a mitochondrial protein that acts as a tumor suppressor and participates in AT2 signaling pathways. Other variants may encode nuclear or transmembrane proteins but it has not been determined whether they also participate in AT2 signaling pathways. [provided by RefSeq, Jul 2008]. Transcript Variant: This variant (5), also known as ATIP1, lacks multiple 5 exons but has an alternate 5' exon, compared to variant 1. It encodes the shortest isoform (5) which has a much shorter and distinct N- |

TABLE 3-continued

| Gene Number | Gene Name | Exon overlap | NCBI Gene ID | Gene Description | RefSeq Summmary |
|---|---|---|---|---|---|
| 288 | MVP | Y | 9961 | major vault protein | terminus, compared to isoform 1. Isoform 5 is a mitochondrial protein. Publication Note: This RefSeq record includes a subset of the publications that are available for this gene. Please see the Gene record to access additional publications. This gene encodes the major vault protein which is a lung resistance-related protein. Vaults are multi-subunit structures that may be involved in nucleo-cytoplasmic transport. This protein mediates drug resistance, perhaps via a transport process. It is widely distributed in normal tissues, and overexpressed in multidrug-resistant cancer cells. The protein overexpression is a potentially useful marker of clinical drug resistance. This gene produces two transcripts by using two alternative exon 2 sequences; however, the open reading frames are the same in both transcripts. [provided by RefSeq, Jul 2008]. Transcript Variant: This variant (1) is the longer transcript. Variants 1 and 2 encode the same protein. Publication Note: This RefSeq record includes a subset of the publications that are available for this gene. Please see the Gene record to access additional publications. |
| 289 | MYH6 | Y | 4624 | myosin-6 | Cardiac muscle myosin is a hexamer consisting of two heavy chain subunits, two light chain subunits, and two regulatory subunits. This gene encodes the alpha heavy chain subunit of cardiac myosin. The gene is located 4kb downstream of the gene encoding the beta heavy chain subunit of cardiac myosin. Mutations in this gene cause familial hypertrophic cardiomyopathy and atrial septal defect 3. [provided by RefSeq, Mar 2010]. |
| 290 | MYH7 | Y | 4625 | myosin-7 | Muscle myosin is a hexameric protein containing 2 heavy chain subunits, 2 alkali light chain subunits, and 2 regulatory light chain subunits. This gene encodes the beta (or slow) heavy chain subunit of cardiac myosin. It is expressed predominantly in normal human ventricle. It is also expressed in skeletal muscle tissues rich in slow-twitch type I muscle fibers. Changes in the relative abundance of this protein and the alpha (or fast) heavy subunit of cardiac myosin correlate with the contractile velocity of cardiac muscle. Its expression is also altered during thyroid hormone depletion and hemodynamic overloading. Mutations in this gene are associated with familial hypertrophic cardiomyopathy, myosin storage myopathy, dilated cardiomyopathy, and Laing early-onset distal myopathy. [provided by RefSeq, Jul 2008]. |
| 291 | MYOM2 | Y | 9172 | myomesin-2 | The giant protein titin, together with its associated proteins, interconnects the major structure of sarcomeres, the M bands and Z discs. The C-terminal end of the titin string extends into the M line, where it binds tightly to M-band constituents of apparent molecular masses of 190 kD and 165 kD. The predicted MYOM2 protein contains 1,465 amino acids. Like MYOM1, MYOM2 has a unique N-terminal domain followed by 12 repeat domains with strong homology to either fibronectin type III or immunoglobulin C2 domains. Protein sequence comparisons suggested that the MYOM2 protein and bovine M protein are identical. [provided by RefSeq, Jul 2008]. |
| 292 | MZT2A | Y | 653784 | mitotic-spindle organizing protein 2A | N/A |
| 293 | NALCN | N | 259232 | sodium leak channel non-selective protein | NALCN forms a voltage-independent, nonselective, noninactivating cation channel permeable to Na is responsible for the neuronal background sodium leak conductance (Lu et al., 2007 [PubMed 17448995]).[supplied by OMIM, Mar 2008]. |
| 294 | NAPEPLD | Y | 222236 | N-acyl-phosphatidylethanolamine-hydrolyzing phospholipase D | NAPEPLD is a phosphatidylethanolamine (NAPE) in the second step of the biosynthesis of N-acylethanolamine (NAE) from N-acyl-phosphatidylethanolamine (NAPE) in the second step of the biosynthesis of N-acylethanolamine (Okamoto et al., 2004 [PubMed 14634025]).[supplied by OMIM, Oct 2008]. Transcript Variant: This variant (2) differs in the 3' UTR, compared to variant 1. Variants 1 and 2 encode the same protein. Sequence Note: This RefSeq record was created from transcript and genomic sequence data because no single transcript was available for the full length of the gene. The extent of this transcript is supported by transcript alignments. |
| 295 | NAT15 | Y | N/A | N/A | N/A |
| 296 | NBPF9 | Y | uncharacterized protein LOC400818 | N/A | N/A |
| 297 | NCRNA00029 | Y | N/A | N/A | N/A |
| 298 | NCRNA00115 | Y | N/A | N/A | N/A |
| 299 | NCRNA00183 | N | N/A | N/A | N/A |
| 300 | NDST3 | N | 9348 | bifunctional heparan sulfate N-deacetylase/N-sulfotransferase 3 | This gene encodes a member of the heparan sulfate/heparin GlcNAc N-deacetylase/ N-sulfotransferase family. The encoded enzyme is a type II transmembrane protein that resides in the Golgi apparatus. This monomeric bifunctional enzyme catalyzes the N-deacetylation and N-sulfation of N-acetylglucosamine residues in heparan sulfate and heparin, which are the initial chemical modifications required for the biosynthesis of the functional oligosaccharide sequences that define the specific ligand binding activities of heparan sulfate and heparin. [provided by RefSeq, Nov 2008]. |

TABLE 3-continued

| Gene Number | Gene Name | Exon overlap | NCBI Gene ID | Gene Description | RefSeq Summmary |
|---|---|---|---|---|---|
| 301 | NKAIN2 | N | 154215 | sodium/potassium-transporting ATPase subunit beta-1-interacting protein 2 isoform 2 | The protein encoded by this gene is a transmembrane protein that interacts with the beta subunit of Na,K-ATPase (ATP1B1). A chromosomal translocation involving this gene is a cause of lymphoma. At least two transcript variants encoding different isoforms have been found for this gene. [provided by RefSeq, May 2010]. Transcript Variant: This variant (2) lacks an alternate in-frame exon compared to variant 1. The resulting isoform (2) has the same N- and C-termini but is shorter compared to isoform 1. |
| 302 | NLGN4X | Y | 57502 | neuroligin-4, X-linked | This gene encodes a member of a family of neuronal cell surface proteins. Members of this family may act as splice site-specific ligands for beta-neurexins and may be involved in the formation and remodeling of central nervous system synapses. The encoded protein interacts with discs, large (Drosophila) homolog 4 (DLG4). Mutations in this gene have been associated with autism and Asperger syndrome. Two transcript variants encoding the same protein have been identified for this gene. [provided by RefSeq, Jul 2008]. Transcript Variant: This variant (2) differs in the 5 UTR compared to variant 1. Variants 1 and 2 encode the same isoform. |
| 303 | NLRC3 | Y | 197358 | protein NLRC3 | N/A |
| 304 | NME4 | Y | 4833 | nucleoside diphosphate kinase, mitochondrial precursor | The nucleoside diphosphate (NDP) kinases (EC 2.7.4.6) are ubiquitous enzymes that catalyze transfer of gamma-phosphates, via a phosphohistidine intermediate, between nucleoside and dioxynucleoside tri- and diphosphates. The enzymes are products of the nm23 gene family, which includes NME4 (Milon et al., 1997 [PubMed 9099850]).[supplied by OMIM, Mar 2008]. |
| 305 | NRG1 | N | 3084 | pro-neuregulin-1, membrane-bound isoform isoform HRG-beta2b | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (HRG-beta2b) lacks an internal exon and the 3' exon, but has an alternate 3' UTR, compared to variant HRG-beta1. The resulting isoform (HRG-beta2b) lacks an internal segment and is C-terminal truncated, compared to isoform HRG-beta1. |
| 306 | NSDHL | Y | 50814 | sterol-4-alpha-carboxylate 3-dehydrogenase, decarboxylating | The protein encoded by this gene is localized in the endoplasmic reticulum and is involved in cholesterol biosynthesis. Mutations in this gene are associated with CHILD syndrome, which is X-linked dominant disorder of lipid metabolism with disturbed cholesterol biosynthesis, and typically lethal in males. Alternatively spliced transcript variants with differing 5' UTR have been found for this gene. [provided by RefSeq, Jul 2008]. Transcript Variant: This variant (1) represents the more predominant transcript. Transcript variants 1 and 2 encode the same protein. |
| 307 | NSF | N | 4905 | N/A | N/A |
| 308 | NTM | N | 50863 | neurotrimin isoform 2 precursor | This gene encodes a member of the IgLON (LAMP, OBCAM, Ntm) family of immunoglobulin (Ig) domain-containing glycosylphosphatidylinositol (GPI)-anchored cell adhesion molecules. The encoded protein may promote neurite outgrowth and adhesion via a homophilic mechanism. This gene is closely linked to a related family member, opioid binding protein/cell adhesion molecule-like (OPCML), on chromosome 11. Multiple transcript variants encoding different isoforms have been found for this gene. [provided by RefSeq, Jan 2009]. Transcript Variant: This variant (2) differs in the 5' UTR and in the coding region compared to variant 3, resulting in a protein that maintains the reading frame but is shorter and has a distinct N-terminus, compared to isoform 3. |
| 309 | NTNG2 | Y | 84628 | netrin-G2 precursor | N/A |
| 310 | NUDT10 | Y | 170685 | diphosphoinositol polyphosphate phosphohydrolase 3-alpha | NUDT10 belongs to a subgroup of phosphohydrolases that preferentially attack diphosphoinositol polyphosphates (Hidaka et al., 2002 [PubMed 12105228]).[supplied by OMIM, Mar 2008]. Sequence Note: removed 2 bases from the 5' end that did not align to the reference genome assembly. |
| 311 | NUDT11 | Y | 55190 | diphosphoinositol polyphosphate phosphohydrolase 3-beta | NUDT11 belongs to a subgroup of phosphohydrolases that preferentially attack diphosphoinositol polyphosphates (Hidaka et al., 2002 [PubMed 12105228]).[supplied by OMIM, Mar 2008]. |
| 312 | OLFM3 | Y | 118427 | noelin-3 precursor | N/A |
| 313 | OR13H1 | Y | 347468 | olfactory receptor 13H1 | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The |

TABLE 3-continued

| Gene Number | Gene Name | Exon overlap | NCBI Gene ID | Gene Description | RefSeq Summary |
|---|---|---|---|---|---|
| 314 | OR2T29 | Y | 343563 | olfactory receptor 2T29 | olfactory receptor gene family is the largest in the genome. The nomenclature assigned to the olfactory receptor genes and proteins for this organism is independent of other organisms. [provided by RefSeq, Jul 2008]. |
| 315 | OR4C46 | Y | 119749 | olfactory receptor 4C46 | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, Jul 2008]. Sequence Note: The RefSeq transcript and protein were derived from genomic sequence to make the sequence consistent with the reference genome assembly. The genomic coordinates used for the transcript record were based on homologous alignments. |
| 316 | OR51A2 | Y | 401667 | olfactory receptor 51A2 | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, Jul 2008]. |
| 317 | OR52E8 | Y | 390079 | olfactory receptor 52E8 | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, Jul 2008]. |
| 318 | OR52N1 | Y | 79743 | olfactory receptor 52N1 | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, Jul 2008]. |
| 319 | OR7E5P | Y | 219445 | N/A | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. This family member is believed to be a pseudogene. [provided by RefSeq, Jun 2009]. Sequence Note: This RefSeq record was created from transcript and genomic sequence data to make the sequence consistent with the reference genome assembly. The genomic coordinates used for the transcript record were based on transcript alignments. |
| 320 | OR8B2 | Y | 26595 | olfactory receptor 8B2 | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, Jul 2008]. |

TABLE 3-continued

| Gene Number | Gene Name | Exon overlap | NCBI Gene ID | Gene Description | RefSeq Summmary |
|---|---|---|---|---|---|
| 321 | OXR1 | N | 55074 | oxidation resistance protein 1 isoform 2 | N/A |
| 322 | PACS2 | Y | 23241 | phosphofurin acidic cluster sorting protein 2 isoform 1 | N/A |
| 323 | PALM2 | N | 114299 | paralemmin-2 isoform a | N/A |
| 324 | PALM2-AKAP2 | N | 445815 | PALM2-AKAP2 protein isoform 2 | PALM2-AKAP2 mRNAs are naturally occurring read-through products of the neighboring PALM2 and AKAP2 genes. The significance of these read-through mRNAs and the function the resulting fusion protein products have not yet been determined. Alternative splicing of this gene results in several transcript variants encoding different isoforms, but the full-length nature of some of these variants has not been defined. [provided by RefSeq, Oct 2010]. Transcript Variant: This variant (2) lacks an in-frame exon near the 3 coding region compared to variant 1. It encodes a shorter isoform (2) but has identical N- and C-termini to isoform 1. |
| 325 | PBMUCL1 | Y | N/A | N/A | N/A |
| 326 | PCDH15 | N | 65217 | protocadherin-15 isoform CD1-4 precursor | This gene is a member of the cadherin superfamily. Family members encode integral membrane proteins that mediate calcium-dependent cell-cell adhesion. It plays an essential role in maintenance of normal retinal and cochlear function. Mutations in this gene result in hearing loss and Usher Syndrome Type IF (USH1F). Extensive alternative splicing resulting in multiple isoforms has been observed in the mouse ortholog. Similar alternatively spliced transcripts are inferred to occur inhuman, and additional variants are likely to occur. [provided by RefSeq, Dec 2008]. Transcript Variant: This variant (C) lacks two alternate in-frame exons in the 5' and 3' coding region, compared to variant A. The resulting isoform (CD1-4) lacks a 5-aa segment near the N-terminus and a 2-aa segment near the C-terminus, compared to isoform CD1-1. Publication Note: This RefSeq record includes a subset of the publications that are available for this gene. Please see the Gene record to access additional publications. |
| 327 | PCDHB16 | Y | 57717 | protocadherin beta-16 precursor | This gene is a member of the protocadherin beta gene cluster, one of three related gene clusters tandemly linked on chromosome five. The gene clusters demonstrate an unusual genomic organization similar to that of B-cell and T-cell receptor gene clusters. The beta cluster contains 16 genes and 3 pseudogenes, each encoding 6 extracellular cadherin domains and a cytoplasmic tail that deviates from others in the cadherin superfamily. The extracellular domains interact in a homophilic manner to specify differential cell-cell connections. Unlike the alpha and gamma clusters, the transcripts from these genes are made up of only one large exon, not sharing common 3' exons as expected. These neural cadherin-like cell adhesion proteins are integral plasma membrane proteins. Their specific functions are unknown but they most likely play a critical role in the establishment and function of specific cell-cell neural connections. [provided by RefSeq, Jul 2008]. |
| 328 | PCDHB8 | Y | 56128 | protocadherin beta-8 precursor | This gene is a member of the protocadherin beta gene cluster, one of three related gene clusters tandemly linked on chromosome five. The gene clusters demonstrate an unusual genomic organization similar to that of B-cell and T-cell receptor gene clusters. The beta cluster contains 16 genes and 3 pseudogenes, each encoding 6 extracellular cadherin domains and a cytoplasmic tail that deviates from others in the cadherin superfamily. The extracellular domains interact in a homophilic manner to specify differential cell-cell connections. Unlike the alpha and gamma clusters, the transcripts from these genes are made up of only one large exon, not sharing common 3' exons as expected. These neural cadherin-like cell adhesion proteins are integral plasma membrane proteins. Their specific functions are unknown but they most likely play a critical role in the establishment and function of specific cell-cell neural connections. [provided by RefSeq, Jul 2008]. |
| 329 | PCNT | Y | 5116 | pericentrin | The protein encoded by this gene binds to calmodulin and is expressed in the centrosome. It is an integral component of the pericentriolar material (PCM). The protein contains a series of coiled-coil domains and a highly conserved PCM targeting motif called the PACT domain near its C-terminus. The protein interacts with the microtubule nucleation component gamma-tubulin and is likely important to normal functioning of the centrosomes, cytoskeleton, and cell-cycle progression. Mutations in this gene cause Seckel syndrome-4 and microcephalic osteodysplastic primordial dwarfism type II. [provided by RefSeq, Jul 2008]. Publication Note: This RefSeq record includes a subset of the publications that are available for this gene. Please see the Gene record to access additional publications. |
| 330 | PCYT1A | Y | 5130 | choline-phosphate cytidylyltransferase A | N/A |
| 331 | PDCD6IP | N | 10015 | programmed cell death 6-interacting protein isoform | This gene encodes a protein thought to participate in programmed cell death. Studies using mouse cells have shown that overexpression of this protein can block apoptosis. In addition, the product of this gene binds to the product of the PDCD6 |

TABLE 3-continued

| Gene Number | Gene Name | Exon overlap | NCBI Gene ID | Gene Description | RefSeq Summary |
|---|---|---|---|---|---|
| | | | | 2 | gene, a protein required for apoptosis, in a calcium-dependent manner. This gene product also binds to endophilins, proteins that regulate membrane shape during endocytosis. Overexpression of this gene product and endophilins results in cytoplasmic vacuolization, which may be partly responsible for the protection against cell death. Several alternatively spliced transcript variants encoding different isoforms have been found for this gene. [provided by RefSeq, Jun 2009]. Transcript Variant: This variant (2) uses an alternative in-frame acceptor splice site at an internal coding exon compared to variant 1. This results in an isoform (2) 5 aa longer than isoform 1. |
| 332 | PDE11A | N | 50940 | dual 3',5'-cyclic-AMP and -GMP phosphodiesterase 11A isoform 2 | The 3',5'-cyclic nucleotides cAMP and cGMP function as second messengers in a wide variety of signal transduction pathways. 3',5'-cyclic nucleotide phosphodiesterases (PDEs) catalyze the hydrolysis of cAMP and cGMP to the corresponding 5'-monophosphates and provide a mechanism to downregulate cAMP and cGMP signaling. This gene encodes a member of the PDE protein superfamily. Mutations in this gene are a cause of Cushing disease and adrenocortical hyperplasia. Multiple transcript variants encoding different isoforms have been found for this gene. [provided by RefSeq, Jul 2008]. Transcript Variant: This variant (2) contains a distinct 5 UTR and lacks an in-frame portion of the 5' coding region, compared to variant 4. The resulting isoform (2) has a shorter N-terminus, compared to isoform 4. |
| 333 | PDE4DIP | Y | 9659 | myomegalin isoform 2 | The protein encoded by this gene serves to anchor phosphodiesterase 4D to the Golgi/centrosome region of the cell. Defects in this gene may be a cause of myeloproliferative disorder (MBD) associated with eosinophilia. Several transcript variants encoding different isoforms have been found for this gene. [provided by RefSeq, Aug 2010]. Transcript Variant: This variant (2) lacks multiple 3' exons and has an alternate 3' exon compared to variant 1. The resulting isoform (2) is C-terminal truncated compared to isoform 1. |
| 334 | PDHX | N | 8050 | pyruvate dehydrogenase protein X component mitochondrial isoform 2 | The pyruvate dehydrogenase (PDH) complex is located in the mitochondrial matrix and catalyzes the conversion of pyruvate to acetyl coenzyme A. The PDH complex thereby links glycolysis to Krebs cycle. The PDH complex contains three catalytic subunits, E1, E2, and E3, two regulatory subunits, E1 kinase and E1 phosphatase, and a non-catalytic subunit, E3 binding protein (E3BP). This gene encodes the E3 binding protein subunit; also known as component X of the pyruvate dehydrogenase complex. This protein tethers E3 dimers to the E2 core of the PDH complex. Defects in this gene are a cause of pyruvate dehydrogenase deficiency which results in neurological dysfunction and lactic acidosis in infancy and early childhood. This protein is also a minor antigen for antimitochondrial antibodies. These autoantibodies are present in nearly 95% of patients with the autoimmune liver disease primary biliary cirrhosis (PBC). In PBC, activated T lymphocytes attack and destroy epithelial cells in the bile duct where this protein is abnormally distributed and overexpressed. PBC eventually leads to cirrhosis and liver failure. Alternative splicing results in multiple transcript variants encoding distinct isoforms.[provided by RefSeq, Oct 2009]. Transcript Variant: This variant (2) lacks a segment in the 5' region, resulting in upstream in-frame AUG start codon, as compared to variant 1. The resulting isoform (2) has a shorter and distinct N-terminus, as compared to isoform 1. |
| 335 | PGAM5 | Y | 192111 | serine/threonine-protein phosphatase PGAM5, mitochondrial isoform 3 | N/A |
| 336 | PHF17 | N | 79960 | protein Jade-1 short isoform | N/A |
| 337 | PI4KA | Y | 5297 | phosphatidylinositol 4-kinase alpha isoform 1 | This gene encodes a phosphatidylinositol (PI) 4-kinase which catalyzes the first committed step in the biosynthesis of phosphatidylinositol 4,5-bisphosphate. The mammalian PI 4-kinases have been classified into two types, II and III, based on their molecular mass, and modulation by detergent and adenosine. The protein encoded by this gene is a type III enzyme that is not inhibited by adenosine. Two transcript variants encoding different isoforms have been described for this gene. [provided by RefSeq, Jul 2008]. Transcript Variant: This variant (1) represents the longer transcript and encodes the longer isoform (1). |
| 338 | PLCH1 | N | 23007 | 1-phosphatidylinositol-4,5-bisphosphate phosphodiesterase eta-1 isoform c | PLCH1 is a member of the PLC-eta family of the phosphoinositide-specific phospholipase C (PLC) superfamily of enzymes that cleave phosphatidylinositol 4,5-bisphosphate (PtdIns(4,5)P2) to generate second messengers inositol 1,4,5-trisphosphate (IP3) and diacylglycerol (DAG) (Hwang et al., 2005 [PubMed 15702972]).[supplied by OMIM, Jun 2009]. Transcript Variant: This variant (3) has an alternate exon in the 3 end of the coding sequence compared to variant 1. This exon contains an in-frame stop codon, resulting in an isoform (c) that has a shorter and distinct C-terminus compared to isoform a. |

TABLE 3-continued

| Gene Number | Gene Name | Exon overlap | NCBI Gene ID | Gene Description | RefSeq Summmary |
|---|---|---|---|---|---|
| 339 | PLN | Y | 5350 | cardiac phospholamban | The protein encoded by this gene is found as a pentamer and is a major substrate for the cAMP-dependent protein kinase in cardiac muscle. The encoded protein is an inhibitor of cardiac muscle sarcoplasmic reticulum Ca(2+)-ATPase in the unphosphorylated state, but inhibition is relieved upon phosphorylation of the protein. The subsequent activation of the Ca(2+) pump leads to enhanced muscle relaxation rates, thereby contributing to the inotropic response elicited in heart by beta-agonists. The encoded protein is a key regulator of cardiac diastolic function. Mutations in this gene are a cause of inherited human dilated cardiomyopathy with refractory congestive heart failure. [provided by RefSeq, Jul 2008]. |
| 340 | POTEA | Y | 340441 | POTE ankyrin domain family member A isoform 2 | N/A |
| 341 | PPAP2C | Y | 8612 | lipid phosphate phosphohydrolase 2 isoform 1 | The protein encoded by this gene is a member of the phosphatidic acid phosphatase (PAP) family. PAPs convert phosphatidic acid to diacylglycerol, and function in de novo synthesis of glycerolipids as well as in receptor-activated signal transduction mediated by phospholipase D. This protein is similar to phosphatidic acid phosphatase type 2A (PPAP2A) and type 2B (PPAP2B). All three proteins contain 6 transmembrane regions, and a consensus N-glycosylation site. This protein has been shown to possess membrane associated PAP activity. Three alternatively spliced transcript variants encoding distinct isoforms have been reported. [provided by RefSeq, Jul 2008]. Transcript Variant: This variant (1) differs in the 5′ region, including the 5′ UTR and a part of the coding region, as compared to variant 3. The resulting isoform (1) has a distinct and shorter N-terminus, as compared to isoform 3. |
| 342 | PPIAL4A | Y | 164022 | peptidylprolyl cis-trans isomerase A-like 4B | N/A |
| 343 | PPIAL4B | Y | 653505 | peptidylprolyl cis-trans isomerase A-like 4A/B/C | N/A |
| 344 | PPIAL4C | Y | 653598 | peptidylprolyl cis-trans isomerase A-like 4A/B/C | N/A |
| 345 | PPP4C | Y | 5531 | serine/threonine-protein phosphatase 4 catalytic subunit | N/A |
| 346 | PRG1 | Y | 23574 | N/A | N/A |
| 347 | PRINS | Y | 100169750 | N/A | N/A |
| 348 | PROL1 | Y | 58503 | proline-rich protein 1 precursor | This gene encodes a member of the proline-rich protein family. The protein may provide a protective function at the eye surface. [provided by RefSeq, Jul 2008]. |
| 349 | PRR25 | Y | 388199 | proline-rich protein 25 | N/A |
| 350 | PRRG1 | Y | 5638 | transmembrane gamma-carboxyglutamic acid protein 1 isoform 1 precursor | This gene encodes a vitamin K-dependent, gamma-carboxyglutamic acid (Gla)-containing, single-pass transmembrane protein. This protein contains a Gla domain at the N-terminus, preceded by a propeptide sequence required for post-translational gamma-carboxylation of specific glutamic acid residues by a vitamin K-dependent gamma-carboxylase. The C-terminus is proline-rich containing PPXY and MOO motifs found in a variety of signaling and cytoskeletal proteins. This gene is highly expressed in the spinal cord. Several alternatively spliced transcript variants have been found for this gene. [provided by RefSeq, Mar 2010]. Transcript Variant: This variant (2) is missing a 5′ non-coding exon compared to variant 1. Variants 1-4 encode the same isoform (1). |
| 351 | PRRT2 | Y | 112476 | proline-rich transmembrane protein 2 | N/A |
| 352 | PRSS1 | Y | 5644 | trypsin-1 preproprotein | This gene encodes a trypsinogen, which is a member of the trypsin family of serine proteases. This enzyme is secreted by the pancreas and cleaved to its active form in the small intestine. It is active on peptide linkages involving the carboxyl group of lysine or arginine. Mutations in this gene are associated with hereditary pancreatitis. This gene and several other trypsinogen genes are localized to the T cell receptor beta locus on chromosome 7. [provided by RefSeq, Jul 2008]. |
| 353 | PRSS2 | Y | 5645 | trypsin-2 preproprotein | This gene encodes a trypsinogen, which is a member of the trypsin family of serine proteases. This enzyme is secreted by the pancreas and cleaved to its active form in the small intestine. It is active on peptide linkages involving the carboxyl group of lysine or arginine. This gene and several other trypsinogen genes are localized to the T cell receptor beta locus on chromosome 7. [provided by RefSeq, Jul 2008]. |
| 354 | PTGER3 | Y | 5733 | prostaglandin E2 receptor EP3 subtype isoform 4 | The protein encoded by this gene is a member of the G-protein coupled receptor family. This protein is one of four receptors identified for prostaglandin E2 (PGE2). This receptor may have many biological functions, which involve |

TABLE 3-continued

| Gene Number | Gene Name | Exon overlap | NCBI Gene ID | Gene Description | RefSeq Summmary |
|---|---|---|---|---|---|
| 355 | PTPN4 | Y | 5775 | tyrosine-protein phosphatase non-receptor type 4 | digestion, nervous system, kidney reabsorption, and uterine contraction activities. Studies of the mouse counterpart suggest that this receptor may also mediate adrenocorticotropic hormone response as well as fever generation in response to exogenous and endogenous stimuli. Multiple transcript variants encoding different isoforms have been found for this gene. [provided by RefSeq, Aug 2009]. Transcript Variant: This variant (4) has multiple differences compared to variant 1. The resulting protein (isoform 4) has a distinct and shorter C-terminus, as compared to isoform 1. Transcript variants 4, 9 and 11 encode the same protein. Other names for variant 4 are EP3 subtype Ib, pEPR-Ib, and EP3aI. The protein encoded by this gene is a member of the protein tyrosine phosphatase (PTP) family. PTPs are known to be signaling molecules that regulate a variety of cellular processes including cell growth, differentiation, mitotic cycle, and oncogenic transformation. This protein contains a C-terminal PTP domain and an N-terminal domain homologous to the band 4.1 superfamily of cytoskeletal-associated proteins. This PTP has been shown to interact with glutamate receptor delta 2 and epsilon subunits, and is thought to play a role in signalling downstream of the glutamate receptors through tyrosine dephosphorylation. [provided by RefSeq, Jul 2008]. |
| 356 | PXDNL | N | 137902 | peroxidasin-like protein precursor | N/A |
| 357 | PYCR1 | Y | 5831 | pyrroline-5-carboxylate reductase 1, mitochondrial isoform 1 | This gene encodes an enzyme that catalyzes the NAD(P)H-dependent conversion of pyrroline-5-carboxylate to proline. This enzyme may also play a physiological role in the generation of NADP(+) in some cell types. The protein forms a homopolymer and localizes to the mitochondrion. Alternate splicing results in two transcript variants encoding different isoforms. [provided by RefSeq, Jul 2008]. Transcript Variant: This variant (1) encodes the longer isoform (1) of this protein. |
| 358 | QPRT | Y | 23475 | nicotinate-nucleotide pyrophosphorylase [carboxylating] precursor | This gene encodes a key enzyme in catabolism of quinolinate, an intermediate in the tryptophan-nicotinamide adenine dinucleotide pathway. Quinolinate acts as a most potent endogenous exitotoxin to neurons. Elevation of quinolinate levels in the brain has been linked to the pathogenesis of neurodegenerative disorders such as epilepsy, Alzheimer's disease, and Huntington's disease. [provided by RefSeq, Jul 2008]. |
| 359 | RANBP1 | Y | 5902 | ran-specific GTPase-activating protein | Ran/TC4-binding protein, RanBP1, interacts specifically with GTP-charged RAN. RANBP1 encodes a 23-kD protein that binds to RAN complexed with GTP but not GDP. RANBP1 does not activate GTPase activity of RAN but does markedly increase GTP hydrolysis by the RanGTPase-activating protein (RanGAP1). The RANBP1 cDNA encodes a 201-amino acid protein that is 92% similar to its mouse homolog. In both mammalian cells and in yeast, RANBP1 acts as a negative regulator of RCC1 by inhibiting RCC1-stimulated guanine nucleotide release from RAN. [provided by RefSeq, Jul 2008]. |
| 360 | RASA3 | Y | 22821 | ras GTPase-activating protein 3 | The protein encoded by this gene is member of the GAP1 family of GTPase-activating proteins. The gene product stimulates the GTPase activity of normal RAS p21 but not its oncogenic counterpart. Acting as a suppressor of RAS function, the protein enhances the weak intrinsic GTPase activity of RAS proteins resulting in the inactive GDP-bound form of RAS, thereby allowing control of cellular proliferation and differentiation. This family member is an inositol 1,3,4,5-tetrakisphosphate-binding protein, like the closely related RAS p21 protein activator 2. The two family members have distinct pleckstrin-homology domains, with this particular member having a domain consistent with its localization to the plasma membrane. [provided by RefSeq, Jul 2008]. |
| 361 | RASGEF1A | Y | 221002 | ras-GEF domain-containing family member 1A | N/A |
| 362 | RBMS3 | N | 27303 | RNA-binding motif, single-stranded-interacting protein 3 isoform 4 | This gene encodes an RNA-binding protein that belongs to the c-myc gene single-strand binding protein family. These proteins are characterized by the presence of two sets of ribonucleoprotein consensus sequence (RNP-CS) that contain conserved motifs, RNP1 and RNP2, originally described in RNA binding proteins, and required for DNA binding. These proteins have been implicated in such diverse functions as DNA replication, gene transcription, cell cycle progression and apoptosis. The encoded protein was isolated by virtue of its binding to an upstream element of the alpha2(I) collagen promoter. The observation that this protein localizes mostly in the cytoplasm suggests that it may be involved in a cytoplasmic function such as controlling RNA metabolism, rather than transcription. Multiple alternatively spliced transcript variants encoding different isoforms have been found for this gene. [provided by RefSeq, Apr 2010]. Transcript Variant: This variant (4) differs in the 3 UTR and has multiple differences in the coding region, compared to variant 1. The encoded isoform (4) is shorter and lacks the last aa, compared to isoform 1. Sequence Note: This RefSeq record was created from transcript and genomic sequence data to make the sequence consistent with the reference genome assembly. The genomic coordinates used for the transcript record were based on transcript alignments. |

TABLE 3-continued

| Gene Number | Gene Name | Exon overlap | NCBI Gene ID | Gene Description | RefSeq Summmary |
|---|---|---|---|---|---|
| 363 | RD3 | Y | 343035 | protein RD3 | This gene encodes a retinal protein that is associated with promyelocytic leukemia-gene product (PML) bodies in the nucleus. Mutations in this gene cause Leber congenital amaurosis type 12, a disease that results in retinal degeneration. Alternative splicing results in multiple transcript variants. [provided by RefSeq, Sep 2009]. Transcript Variant: This variant (1) represents the longer transcript. Both variants 1 and 2 encode the same protein. |
| 364 | RET | U | 5979 | proto-oncogene tyrosine-protein kinase receptor Ret isoform c precursor | This gene, a member of the cadherin superfamily, encodes one of the receptor tyrosine kinases, which are cell-surface molecules that transduce signals for cell growth and differentiation. This gene plays a crucial role in neural crest development, and it can undergo oncogenic activation in vivo and in vitro by cytogenetic rearrangement. Mutations in this gene are associated with the disorders multiple endocrine neoplasia, type HA, multiple endocrine neoplasia, type JIB, Hirschsprung disease, and medullary thyroid carcinoma. Two transcript variants encoding different isoforms have been found for this gene. Additional transcript variants have been described but their biological validity has not been confirmed. [provided by RefSeq, Jul 2008]. Transcript Variant: This variant (4) differs in the 3' UTR and coding region compared to variant 2. The resulting isoform (c) is shorter and has a distinct C-terminus compared to isoform a. This isoform is also known as Ret9. |
| 365 | RLN3 | Y | 117579 | relaxin-3 preproprotein | Relaxins are known endocrine and autocrine/paracrine hormones, belonging to the insulin gene superfamily. In the human there are three non-allelic relaxin genes, RLN1, RLN2 and RLN3. RLN1 and RLN2 share high sequence homology. Relaxin is produced by the ovary, and targets the mammalian reproductive system to ripen the cervix, elongate the pubic symphysis and inhibit uterine contraction. It may have additional roles in enhancing sperm motility, regulating blood pressure, controlling heart rate and releasing oxytocin and vasopressin. The protein encoded by this gene is a member of the relaxin family. The active form of the encoded protein consists of an A chain and a B chain but their cleavage sites are not definitely described yet. It may play a role in neuropeptide signaling processes. [provided by RefSeq, Jul 2008]. |
| 366 | RNF141 | Y | 50862 | RING finger protein 141 | The protein encoded by this gene contains a RING finger, a motif known to be involved in protein-DNA and protein-protein interactions. Abundant expression of this gene was found in the testicular tissue of fertile men, but was not detected in azoospermic patients. Studies of the mouse counterpart suggest that this gene may function as a testis specific transcription factor during spermatogenesis. [provided by RefSeq, Jul 2008]. |
| 367 | RNF208 | Y | 727800 | RING finger protein 208 | N/A |
| 368 | RPSAP58 | Y | 388524 | N/A | N/A |
| 369 | RPTOR | Y | 57521 | regulatory-associated protein of mTOR isoform 2 | This gene encodes a component of a signaling pathway that regulates cell growth in response to nutrient and insulin levels. The encoded protein forms a stoichiometric complex with the mTOR kinase, and also associates with eukaryotic initiation factor 4E-binding protein-1 and ribosomal protein S6 kinase. The protein positively regulates the downstream effector ribosomal protein S6 kinase, and negatively regulates the mTOR kinase. Multiple transcript variants encoding different isoforms have been found for this gene. [provided by RefSeq, Sep 2009]. Transcript Variant: This variant (2) lacks alternate in-frame exons compared to variant 1. This results in a shorter protein (isoform 2) compared to isoform 1. The transcript is described in PMID:19388141. Sequence Note: The RefSeq transcript and protein were derived from genomic sequence to make the sequence consistent with the reference genome assembly. The genomic coordinates used for the transcript record were based on alignments. |
| 370 | RPUSD1 | Y | 113000 | RNA pseudouridylate synthase domain-containing protein 1 | N/A |
| 371 | RTTN | N | 25914 | rotatin | RTTN is required for the early developmental processes of left-right (L-R) specification and axial rotation and may play a role in notochord development (Faisst et al., 2002 [PubMed 11900971]).[supplied by OMIM, Mar 2008]. |
| 372 | SAE1 | Y | 10055 | SUMO-activating enzyme subunit 1 isoform b | Posttranslational modification of proteins by the addition of the small protein SUMO (see SUMO1; MIM 601912), or sumoylation, regulates protein structure and intracellular localization. SAE1 and UBA2 (MIM 613295) form a heterodimer that functions as a SUMO-activating enzyme for the sumoylation of proteins (Okuma et al., 1999 [PubMed 9920803]).[supplied by OMIM, Mar 2010]. Transcript Variant: This variant (2) lacks two alternate exons, compared to variant 1, which causes a frameshift. The resulting protein (isoform b) has a distinct C-terminus and is shorter than isoform a. |
| 373 | SBF2 | Y | 81846 | myotubularin-related protein 13 | This gene encodes a pseudophosphatase and member of the myotubularin-related protein family. This gene maps within the CMT4B2 candidate region of chromosome 11p15 and mutations in this gene have been associated with Charcot-Marie-Tooth Disease, type 4B2. [provided by RefSeq, Jul 2008]. Publication Note: This RefSeq record includes a subset of the publications that are available for this gene. Please see the Gene record to access additional publications. |

TABLE 3-continued

| Gene Number | Gene Name | Exon overlap | NCBI Gene ID | Gene Description | RefSeq Summmary |
|---|---|---|---|---|---|
| 374 | SCN3A | Y | 6328 | sodium channel protein type 3 subunit alpha isoform 3 | Voltage-gated sodium channels are transmembrane glycoprotein complexes composed of a large alpha subunit with 24 transmembrane domains and one or more regulatory beta subunits. They are responsible for the generation and propagation of action potentials in neurons and muscle. This gene encodes one member of the sodium channel alpha subunit gene family, and is found in a cluster of five alpha subunit genes on chromosome 2. Multiple transcript variants encoding different isoforms have been found for this gene. [provided by RefSeq, Jul 2008]. Transcript Variant: This variant (3), also known as the neonatal form, uses an alternate in-frame splice site in the central coding region and an alternate form of an exon in the 5 coding region, compared to variant 1. The resulting isoform (3) is shorter than isoform 1, and contains one amino acid substitution relative to isoform 2. |
| 375 | SDK1 | N | 221935 | protein sidekick-1 | N/A |
| 376 | SEC22B | Y | 9554 | vesicle-trafficking protein SEC22b precursor | The protein encoded by this gene is a member of the SEC22 family of vesicle trafficking proteins. It seems to complex with SNARE and it is thought to play a role in the ER-Golgi protein trafficking. This protein has strong similarity to Mus musculus and Cricetulus griseus proteins.[provided by RefSeq, Sep 2009]. |
| 377 | SEMA3F | both | 6405 | semaphorin-3F precursor | The semaphorins are a family of proteins that are involved in signaling. All the family members have a secretion signal, a 500-amino acid sema domain, and 16 conserved cysteine residues (Kolodkin et al., 1993 [PubMed 8269517]). Sequence comparisons have grouped the secreted semaphorins into 3 general classes, all of which also have an immunoglobulin domain. The semaphorin III family, consisting of human semaphorin III (SEMA3A; MIM 603961), chicken collapsin, and mouse semaphorins A, D, and E, all have a basic domain at the C terminus. Chicken collapsin contributes to path finding by axons during development by inhibiting extension of growth cones (Luo et al., 1993 [PubMed 8402908]) through an interaction with a collapsin response mediator protein of relative molecular mass 62K (CRMP62) (Goshima et al., 1995 [PubMed 7637782]), a putative homolog of an axonal guidance associated UNC33 gene product (MIM 601168). SEMA3F is a secreted member of the semaphorin III family. [supplied by OMIM, Mar 2008]. |
| 378 | SEPT5 | Y | 5413 | septin-5 isoform2 | This gene is a member of the septin gene family of nucleotide binding proteins, originally described in yeast as cell division cycle regulatory proteins. Septins are highly conserved in yeast, Drosophila, and mouse and appear to regulate cytoskeletal organization. Disruption of septin function disturbs cytokinesis and results in large multinucleate or polyploid cells. This gene is mapped to 22q11, the region frequently deleted in DiGeorge and velocardiofacial syndromes. A translocation involving the MLL gene and this gene has also been reported in patients with acute myeloid leukemia. Alternative splicing results in multiple transcript variants. The presence of a non-consensus polyA signal (AACAAT) in this gene also results in read-through transcription into the downstream neighboring gene (GP1BB; platelet glycoprotein Ib), whereby larger, non-coding transcripts are produced. [provided by RefSeq, Dec 2010]. Transcript Variant: This variant (2) differs in the 5' UTR, lacks a portion of the 5' coding region, and uses an alternate start codon, compared to variant 1. The encoded isoform 2 has a shorter and distinct N-terminus, compared to isoform 1. Publication Note: This RefSeq record includes a subset of the publications that are available for this gene. Please see the Gene record to access additional publications. |
| 379 | SEPT5-GP1BB | Y | 100526833 | N/A | This locus represents naturally occurring read-through transcription between the neighboring SEPT5 (septin 5) and GP1BB (glycoprotein Ib (platelet), beta polypeptide) genes on chromosome 22. This read-through transcription arises from inefficient use of an imperfect polyA signal in the upstream SEPT5 gene, whereby transcription continues into the GP1BB gene. Alternative splicing results in multiple read-through variants. The read-through transcripts are candidates for nonsense-mediated mRNA decay (NMD), and are therefore unlikely to produce protein products. [provided by RefSeq, Dec 2010]. |
| 380 | SERPIND1 | Y | 3053 | heparin cofactor 2 precursor | The product encoded by this gene is a serine proteinase inhibitor which rapidly inhibits thrombin in the presence of dermatan sulfate or heparin. The gene contains five exons and four introns. This protein shares homology with antithrombin III and other members of the alpha 1-antitrypsin superfamily. Mutations in this gene are associated with heparin cofactor II deficiency. [provided by RefSeq, Jul 2008]. |
| 381 | SEZ6L2 | Y | 26470 | seizure 6-like protein 2 isoform 6 precursor | This gene encodes a seizure-related protein that is localized on the cell surface. The gene is located in a region of chromosome 16p11.2 that is thought to contain candidate genes for autism spectrum disorders (ASD), though there is no evidence directly implicating this gene in ASD. Increased expression of this gene has been found in lung cancers, and the protein is therefore considered to be a novel prognostic marker for lung cancer. Alternative splicing of this gene results in multiple transcript variants. [provided by RefSeq, Aug 2011]. Transcript Variant: This variant (6) lacks an alternate in-frame exon in the 5 coding region, compared to variant 5, resulting in an isoform (6) that is shorter than isoform 5. |

TABLE 3-continued

| Gene Number | Gene Name | Exon overlap | NCBI Gene ID | Gene Description | RefSeq Summmary |
|---|---|---|---|---|---|
| 382 | SFMBT1 | N | 51460 | scm-like with four MBT domains protein 1 | This gene shares high similarity with the Drosophila Scm (sex comb on midleg) gene. It encodes a protein which contains four malignant brain tumor repeat (mbt) domains and may be involved in antigen recognition. Several alternative splice variants that encode the same protein have been characterized. [provided by RefSeq, Aug 2010]. Transcript Variant: This variant (3) differs in the 5' UTR, compared to variant 1. Variants 1, 2 and 3 encode the same protein. Sequence Note: This RefSeq record was created from transcript and genomic sequence data to make the sequence consistent with the reference genome assembly. The genomic coordinates used for the transcript record were based on transcript alignments. |
| 383 | SGK1 | N | 6446 | serine/threonine-protein kinase Sgk1 isoform 1 | This gene encodes a serine/threonine protein kinase that plays an important role in cellular stress response. This kinase activates certain potassium, sodium, and chloride channels, suggesting an involvement in the regulation of processes such as cell survival, neuronal excitability, and renal sodium excretion. High levels of expression of this gene may contribute to conditions such as hypertension and diabetic nephropathy. Several alternatively spliced transcript variants encoding different isoforms have been noted for this gene. [provided by RefSeq, Jan 2009]. Transcript Variant: This variant (1) represents the predominant transcript and encodes the shortest isoform (1). |
| 384 | SH3BP5L | Y | 80851 | SH3 domain-binding protein 5-like | N/A |
| 385 | SIL1 | Y | 64374 | nucleotide exchange factor SIL1 precursor | This gene encodes a resident endoplasmic reticulum (ER), N-linked glycoprotein with an N-terminal ER targeting sequence, 2 putative N-glycosylation sites, and a C-terminal ER retention signal. This protein functions as a nucleotide exchange factor for another unfolded protein response protein. Mutations in this gene have been associated with Marinesco-Sjogren syndrome. Alternate transcriptional splice variants have been characterized. [provided by RefSeq, Jul 2008]. Transcript Variant: This variant (2) lacks an exon in the 5' UTR compared to variant 1. Variants 1 and 2 encode the same protein. |
| 386 | SIRPB1 | N | 10326 | signal-regulatory protein beta-1 isoform 3 precursor | The protein encoded by this gene is a member of the signal-regulatory-protein (SIRP) family, and also belongs to the immunoglobulin superfamily. SIRP family members are receptor-type transmembrane glycoproteins known to be involved in the negative regulation of receptor tyrosine kinase-coupled signaling processes. This protein was found to interact with TYROBP/DAP12, a protein bearing immunoreceptor tyrosine-based activation motifs. This protein was also reported to participate in the recruitment of tyrosine kinase SYK. Multiple transcript variants encoding different isoforms have been found for this gene. [provided by RefSeq, Feb 2009]. Transcript Variant: This variant (3) differs in the 3' UTR and coding sequence compared to variant 1. The resulting isoform (3) is similar in sequence to isoform 1 and contains the same number of aa as does isoform 1. |
| 387 | SLC10A2 | Y | 6555 | ileal sodium/bile acid cotransporter | This gene encodes a sodium/bile acid cotransporter. This transporter is the primary mechanism for uptake of intestinal bile acids by apical cells in the distal ileum. Bile acids are the catabolic product of cholesterol metabolism, so this protein is also critical for cholesterol homeostasis. Mutations in this gene cause primary bile acid malabsorption (PBAM); mutations in this gene may also be associated with other diseases of the liver and intestines, such as familial hypertriglyceridemia (FHTG). [provided by RefSeq, Mar 2010]. |
| 388 | SLC25A1 | Y | 6576 | N/A | The mitochondrial tricarboxylate transporter (also called citrate transport protein, or CTP) is responsible for the movement of citrate across the mitochondrial inner membrane (Kaplan et al., 1993 [PubMed 8514800]).[supplied by OMIM, Jan 2011]. Transcript Variant: This variant (2) has an alternate 5' exon, compared to variant 1. It includes a uORF which has a strong Kozak signal and overlaps the downstream ORF. It appears that this transcript is a nonsense-mediated mRNA decay candidate. |
| 389 | SLC27A5 | Y | 10998 | bile acyl-CoA synthetase precursor | The protein encoded by this gene is an isozyme of very long-chain acyl-CoA synthetase (VLCS). It is capable of activating very long-chain fatty-acids containing 24- and 26-carbons. It is expressed in liver and associated with endoplasmic reticulum but not with peroxisomes. Its primary role is in fatty acid elongation or complex lipid synthesis rather than in degradation. This gene has a mouse ortholog. [provided by RefSeq, Jul 2008]. |
| 390 | SLC35F2 | N | 54733 | solute carrier family 35 member F2 | N/A |
| 391 | SLC39A11 | N | 201266 | zinc transporter ZIP11 isoform 2 | N/A |
| 392 | SLX4 | Y | 84464 | structure-specific endonuclease subunit SLX4 | This gene encodes a structure-specific endonuclease subunit. The encoded protein contains a central BTB domain and it forms a multiprotein complex with the ERCC4(XPF)-ERCC1, MUS81-EME1, and SLX1 endonucleases, and also associates with MSH2/MSH3 mismatch repair complex, telomere binding complex TERF2(TRF2)-TERF2IP(RAP1), the protein kinase PLK1 and the uncharacterized protein C20orf94. The multiprotein complex is required for repair of specific |

TABLE 3-continued

| Gene Number | Gene Name | Exon overlap | NCBI Gene ID | Gene Description | RefSeq Summmary |
|---|---|---|---|---|---|
| 393 | SMOC2 | N | 64094 | SPARC-related modular calcium-binding protein 2 isoform 2 precursor | types of DNA lesions and is critical for cellular responses to replication fork failure. The encoded protein acts as a docking platform for the assembly of multiple structure-specific endonucleases.[provided by RefSeq, Jan 2011]. This gene encodes a member of the SPARC family (secreted protein acidic and rich in cysteine/osteonectin/BM-40), which are highly expressed during embryogenesis and wound healing. The gene product is a matricellular protein which promotes matrix assembly and can stimulate endothelial cell proliferation and migration, as well as angiogenic activity. Associated with pulmonary function, this secretory gene product contains a Kazal domain, two thymoglobulin type-1 domains, and two EF-hand calcium-binding domains. The encoded protein may serve as a target for controlling angiogenesis in tumor growth and myocardial ischemia. Alternative splicing results in multiple transcript variants. [provided by RefSeq, Oct 2009]. Transcript Variant: This variant (2) uses an alternate in-frame splice site in the central coding region, compared to variant 1. This results in a shorter protein (isoform 2), compared to isoform 1. |
| 394 | SMR3A | Y | 26952 | submaxillary gland androgen-regulated protein 3A precursor | N/A |
| 395 | SMR3B | Y | 10879 | submaxillary gland androgen-regulated protein 3B precursor | N/A |
| 396 | SNAP29 | Y | 9342 | synaptosomal-associated protein 29 | This gene, a member of the SNAP25 gene family, encodes a protein involved in multiple membrane trafficking steps. Two other members of this gene family, SNAP23 and SNAP25, encode proteins that bind a syntaxin protein and mediate synaptic vesicle membrane docking and fusion to the plasma membrane. The protein encoded by this gene binds tightly to multiple syntaxins and is localized to intracellular membrane structures rather than to the plasma membrane. While the protein is mostly membrane-bound, a significant fraction of it is found free in the cytoplasm. Use of multiple polyadenylation sites has been noted for this gene. [provided by RefSeq, Jul 2008]. Sequence Note: This RefSeq record was created from transcript and genomic sequence data because no single transcript was available for the full length of the gene. The extent of this transcript is supported by transcript alignments. |
| 397 | SNTG1 | N | 54212 | gamma-1-syntrophin | The protein encoded by this gene is a member of the syntrophin family. Syntrophins are cytoplasmic peripheral membrane proteins that typically contain 2 pleckstrin homology (PH) domains, a PDZ domain that bisects the first PH domain, and a C-terminal domain that mediates dystrophin binding. This gene is specifically expressed in the brain. Transcript variants for this gene have been described, but their full-length nature has not been determined. [provided by RefSeq, Jul 2008]. |
| 398 | SNUPN | Y | 10073 | snurportin-1 | The nuclear import of the spliceosomal snRNPs U1, U2, U4 and U5, is dependent on the presence of a complex nuclear localization signal. The latter is composed of the 5'-2,2,7-terminal trimethylguanosine (m3G) cap structure of the U snRNA and the Sm core domain. The protein encoded by this gene interacts specifically with m3G-cap and functions as an snRNP-specific nuclear import receptor. Alternatively spliced transcript variants encoding the same protein have been identified for this gene. [provided by RefSeq, Jul 2008]. Transcript Variant: This variant (3) differs in the 5 UTR, compared to variant 1. Variants 1, 2 and 3 encode the same protein. |
| 399 | SNX33 | Y | 257364 | sorting nexin-33 | N/A |
| 400 | SORCS1 | N | 114815 | VPS 10 domain-containing receptor SorCS1 isoform c precursor | This gene encodes one family member of vacuolar protein sorting 10 (VPS10) domain-containing receptor proteins. The VPS10 domain name comes from the yeast carboxypeptidase Y sorting receptor Vps10 protein. Members of this gene family are large with many exons but the CDS lengths are usually less than 3700 nt. Very large introns typically separate the exons encoding the VPS10 domain; the remaining exons are separated by much smaller-sized introns. These genes are strongly expressed in the central nervous system. Two of the five family members (sortilin and sortilin-related receptor) are synthesized as preproproteins; it is not yet known if this encoded protein is also a preproprotein. Alternatively spliced transcript variants encoding different isoforms have been identified. [provided by RefSeq, Jul 2008]. Transcript Variant: This variant (3) differs in the 3 UTR and coding sequence compared to variant 2. The resulting isoform (c) has a shorter and distinct C-terminus compared to isoform b. Sequence Note: This RefSeq record was created from transcript and genomic sequence data to make the sequence consistent with the reference genome assembly. The genomic coordinates used for the transcript record were based on transcript alignments. |
| 401 | SORL1 | N | 6653 | sortilin-related receptor preproprotein | This gene encodes a mosaic protein that belongs to at least two families: the vacuolar protein sorting 10 (VPS10) domain-containing receptor family, and the low density lipoprotein receptor (LDLR) family. The encoded protein also contains fibronectin type III repeats and an epidermal growth factor repeat. The encoded protein is translated as a preproprotein and likely plays roles in endocytosis and sorting. There may be an association between expression of this locus and |

TABLE 3-continued

| Gene Number | Gene Name | Exon overlap | NCBI Gene ID | Gene Description | RefSeq Summmary |
|---|---|---|---|---|---|
| 402 | SPAG16 | N | 79582 | sperm-associated antigen 16 protein isoform 2 | Alzheimer's Disease.[provided by RefSeq, Sep 2010]. Sequence Note: This RefSeq record was created from transcript and genomic sequence data to make the sequence consistent with the reference genome assembly. The genomic coordinates used for the transcript record were based on transcript alignments. Cilia and flagella are comprised of a microtubular backbone, the axoneme, which is organized by the basal body and surrounded by plasma membrane. SPAG16 encodes 2 major proteins that associate with the axoneme of sperm tail and the nucleus of postmeiotic germ cells, respectively (Zhang et al., 2007 [PubMed 17699735]).[supplied by OMIM, Jul 2008]. |
| 403 | SPIN4 | Y | 139886 | spindlin-4 | N/A |
| 404 | SPN | Y | 6693 | leukosialin precursor | The protein encoded by this gene is a major sialoglycoprotein found on the surface of thymocytes, T lymphocytes, monocytes, granulocytes, and some B lymphocytes. It may be part of a physiologic ligand-receptor complex involved in T-cell activation. During T-cell activation, this protein is actively removed from the T-cell-APC (antigen-presenting cell) contact site, suggesting a negative regulatory role in adaptive immune response. [provided by RefSeq, Sep 2011]. |
| 405 | SRGAP2P2 | Y | 647135 | N/A | N/A |
| 406 | SRPK2 | N | 6733 | serine/threonine-protein kinase SRPK2 isoform a | N/A |
| 407 | STK31 | N | 56164 | serine/threonine-protein kinase 31 isoform b | This gene is similar to a mouse gene that encodes a putative protein kinase with a tudor domain, and shows testis-specific expression. Alternative splicing results in multiple transcript variants encoding different isoforms. [provided by RefSeq, Jul 2008]. Transcript Variant: This variant (3) uses an alternate splice-site in the 5' end that results in translation initiation at a downstream start codon, compared to variant 1. The encoded protein (isoform b) has a shorter N-terminus, compared to isoform a. |
| 408 | SUCLG2 | N | 8801 | succinyl-CoA ligase [GDP-forming] subunit beta, mitochondrial isoform 2 precursor | This gene encodes a GTP-specific beta subunit of succinyl-CoA synthetase. Succinyl-CoA synthetase catalyzes the reversible reaction involving the formation of succinyl-CoA and succinate. Alternate splicing results in multiple transcript variants. Pseudogenes of this gene are found on chromosomes 5 and 12. [provided by RefSeq, Apr 2010]. Transcript Variant: This variant (2) differs in the 3'UTR, and 3'coding region, compared to variant 1. The encoded isoform (2) is shorter and has a distinct C-terminus, compared to isoform 1. |
| 409 | SYNE1 | Y | 23345 | nesprin-1 isoform 2 | This gene encodes a spectrin repeat containing protein expressed in skeletal and smooth muscle, and peripheral blood lymphocytes, that localizes to the nuclear membrane. Mutations in this gene have been associated with autosomal recessive spinocerebellar ataxia 8, also referred to as autosomal recessive cerebellar ataxia type 1 or recessive ataxia of Beauce. Alternatively spliced transcript variants encoding different isoforms have been described. [provided by RefSeq, Jul 2008]. Transcript Variant: This variant (2) differs in the 5' UTR and has multiple coding region differences, compared to variant 1. This results in a shorter protein (isoform 2 which has also been referred to as the longer isoform), compared to isoform 1. |
| 410 | SYNGAP1 | N | 8831 | ras GTPase-activating protein SynGAP | The protein encoded by this gene is a major component of the postsynaptic density (PSD), a group of proteins found associated with NMDA receptors at synapses. The encoded protein is phosphoiylated by calmodulin-dependent protein kinase II and dephosphoiylated by NMDA receptor activation. Defects in this gene are a cause of mental retardation autosomal dominant type 5 (MRD5). [provided by RefSeq, Dec 2009]. Publication Note: This RefSeq record includes a subset of the publications that are available for this gene. Please see the Gene record to access additional publications. |
| 411 | SYTL5 | Y | 94122 | synaptotagmin-like protein 5 isoform 1 | The protein encoded by this gene belongs to the synaptotagmin-like (Sip) protein family, which contains a unique homology domain at the N-terminus, referred to as the Slp homology domain (SHD). The SHD functions as a binding site for Rab27A, which plays a role in protein transport. Expression of this gene is restricted to placenta and liver, suggesting that it might be involved in Rab27A-dependent membrane trafficking in specific tissues. Alternatively spliced transcript variants encoding different isoforms have been found for this gene. [provided by RefSeq, Sep 2009]. Transcript Variant: This variant (1) encodes the shorter isoform (1). Variants 1 and 2 encode the same isoform. |
| 412 | TAF7L | Y | 54457 | transcription initiation factor TFIID subunit 7-like isoform 1 | This gene is similar to a mouse gene that encodes a TATA box binding protein-associated factor, and shows testis-specific expression. The encoded protein could be a spermatogenesis-specific component of the DNA-binding general transcription factor complex TFIID. Alternatively spliced transcript variants encoding different isoforms have been found for this gene. [provided by RefSeq, Dec 2009]. Transcript Variant: This variant (1) represents the longer transcript and encodes the longer isoform (1). |
| 413 | TAOK2 | Y | 9344 | serine/threonine-protein kinase TAO2 isoform 3 | This gene encodes a serine/threonine protein kinase that is involved in many different processes, including cell signaling, microtubule organization and stability, and apoptosis. Alternatively spliced transcript variants encoding different isoforms have been described for this gene. [provided by RefSeq, Oct 2011]. Transcript Variant: This variant (3) is alternatively |

TABLE 3-continued

| Gene Number | Gene Name | Exon overlap | NCBI Gene ID | Gene Description | RefSeq Summmary |
|---|---|---|---|---|---|
| 414 | TARSL2 | Y | 123283 | probable threonyl-tRNA synthetase 2, cytoplasmic | spliced at the 3 end compared to variant 1. However, it maintains the reading frame, and encodes a shorter isoform (3) missing a protein segment compared to isoform 1. |
| 415 | TBX1 | Y | 6899 | T-box transcription factor TBX1 isoform B | N/A This gene is a member of a phylogenetically conserved family of genes that share a common DNA-binding domain, the T-box. T-box genes encode transcription factors involved in the regulation of developmental processes. This gene product shares 98% amino acid sequence identity with the mouse ortholog. DiGeorge syndrome (DGS)/velocardiofacial syndrome (VCFS), a common congenital disorder characterized by neural-crest-related developmental defects, has been associated with deletions of chromosome 22q11.2, where this gene has been mapped. Studies using mouse models of DiGeorge syndrome suggest a major role for this gene in the molecular etiology of DGS/VCFS. Several alternatively spliced transcript variants encoding different isoforms have been described for this gene. [provided by RefSeq, Jul 2008]. Transcript Variant: This variant (B) contains an alternate exon 9 and an additional exon 10 compared to variant C. It encodes an isoform (B) with the same N-terminal 336 aa, but an unique C-terminus with respect to isoforms A and C. |
| 416 | TBX6 | Y | 6911 | T-box transcription factor TBX6 | This gene is a member of a phylogenetically conserved family of genes that share a common DNA-binding domain, the T-box. T-box genes encode transcription factors involved in the regulation of developmental processes. Knockout studies in mice indicate that this gene is important for specification of paraxial mesoderm structures. [provided by RefSeq, Aug 2008]. |
| 417 | TCTEX1D2 | Y | 255758 | tctex1 domain-containing protein 2 | N/A |
| 418 | TFB2M | Y | 64216 | dimethyladenosine transferase 2, mitochondrial | N/A |
| 419 | TMSD3 | Y | 80213 | TM2 domain-containing protein 3 isoform b precursor | The protein encoded by this gene contains a structural module related to that of the seven transmembrane domain G protein-coupled receptor superfamily. This protein has sequence and structural similarities to the beta-amyloid binding protein (BBP), but, unlike BBP, it does not regulate a response to beta-amyloid peptide. This protein may have regulatory roles in cell death or proliferation signal cascades. Several alternatively spliced transcript variants of this gene are described but the full length nature of some variants has not been determined. Multiple polyadenylation sites have been found in this gene. [provided by RefSeq, Jul 2008]. Transcript Variant: This variant (2) lacks an exon within the coding region, but maintains the same reading frame, as compared to variant 1. Thus isoform b lacks an internal fragment of 26 aa compared to isoform a. |
| 420 | TM4SF5 | Y | 9032 | transmembrane 4 L6 family member 5 precursor | The protein encoded by this gene is a member of the transmembrane 4 superfamily, also known as the tetraspanin family. Most of these members are cell-surface proteins that are characterized by the presence of four hydrophobic domains. The proteins mediate signal transduction events that play a role in the regulation of cell development, activation, growth and motility. This encoded protein is a cell surface glycoprotein and is highly similar in sequence and structure to transmembrane 4 superfamily member 1. It may play a role in cell proliferation, and overexpression of this protein may be associated with the uncontrolled growth of tumour cells. [provided by RefSeq, Jul 2008]. |
| 421 | TMEM158 | Y | 25907 | transmembrane protein 158 precursor | Constitutive activation of the Ras pathway triggers an irreversible proliferation arrest reminiscent of replicative senescence. Transcription of this gene is upregulated in response to activation of the Ras pathway, but not under other conditions that induce senescence. The encoded protein is similar to a rat cell surface receptor proposed to function in a neuronal survival pathway. [provided by RefSeq, Jul 2008]. |
| 422 | TMEM185A | both | 94548 | transmembrane protein 185A isoform 2 | The protein encoded by this gene is predicted to be a transmembrane protein, but this has not been experimentally determined. This gene is better known for localizing to the CpG island of the fragile site FRAXF. The 5-prime untranslated region of this gene contains a CGG trinucleotide repeat sequence that normally consists of 7-40 tandem CGG repeats but which can expand to greater than 300 repeats. Methylation of the CpG island leads to transcriptional silencing of this gene, but neither the silencing nor an expanded repeat region appear to manifest itself in a clear phenotypic manner. Two transcript variants encoding different isoforms have been found for this gene. [provided by RefSeq, Mar 2010]. Transcript Variant: This variant (2) lacks an alternate in-frame exon compared to variant 1. The resulting isoform (2) has the same N- and C-termini but is shorter compared to isoform 1. Sequence Note: This RefSeq record was created from transcript and genomic sequence data to make the sequence consistent with the reference genome assembly. The genomic coordinates used for the transcript record were based on transcript alignments. |

TABLE 3-continued

| Gene Number | Gene Name | Exon overlap | NCBI Gene ID | Gene Description | RefSeq Summary |
|---|---|---|---|---|---|
| 423 | TMEM219 | Y | 124446 | transmembrane protein 219 | N/A |
| 424 | TMEM27 | Y | 57393 | collectrin precursor | This gene encodes a transmembrane protein that is important for trafficking amino acid transporters to the apical brush border of proximal tubules. It also plays a role in controlling insulin exocytosis by regulating formation of the SNARE (soluble N-ethylmaleimide-sensitive-factor attachment protein receptor) complex in pancreatic beta cells. [provided by RefSeq, Nov 2009]. |
| 425 | TMEM38B | N | 55151 | trimeric intracellular cation channel type B | N/A |
| 426 | TMLHE | both | 55217 | trimethyllysine dioxygenase, mitochondrial isoform 2 precursor | This gene encodes the protein trimethyllysine dioxygenase which is the first enzyme in the carnitine biosynthesis pathway. Carnitine play an essential role in the transport of activated fatty acids across the inner mitochondrial membrane. The encoded protein converts trimethyllysine into hydroxytrimethyllysine. A pseudogene of this gene is found on chromosome X. Alternate splicing results in multiple transcript variants. [provided by RefSeq, May 2010]. Transcript Variant: This variant (2) differs in the 3 UTR and coding region differences, compared to variant 1. The resulting protein (isoform 2) has a distinct C-terminus and is shorter than isoform 1. |
| 427 | TMPRSS11E | Y | 28983 | transmembrane protease serine 11E precursor | N/A |
| 428 | TRIAPA | Y | 51499 | TP53-regulated inhibitor of apoptosis 1 | N/A |
| 429 | TRIML2 | Y | 205860 | probable E3 ubiquitin-protein ligase TRIML2 | N/A |
| 430 | TRMT2A | Y | 27037 | tRNA (uracil-5-)-methyltransferase homolog A | N/A |
| 431 | TSSK2 | Y | 23617 | testis-specific serine/threonine-protein kinase 2 | TSSK2 belongs to a family of serine/threonine kinases highly expressed in testis (Hao et al., 2004 [PubMed 15044604]).[supplied by OMIM, Mar 2008]. |
| 432 | TTC7B | Y | 145567 | tetratricopeptide repeat protein 7B | N/A |
| 433 | UBA3D | Y | 113457 | tubulin alpha-3C/D chain | This gene encodes a member of the alpha tubulin family. Tubulin is a major component of microtubules, which are composed of alpha- and beta-tubulin heterodimers and microtubule-associated proteins in the cytoskeleton. Microtubules maintain cellular structure, function in intracellular transport, and play a role in spindle formation during mitosis. [provided by RefSeq, Jul 2008]. |
| 434 | TUBB4Q | Y | N/A | N/A | N/A |
| 435 | TXLNB | N | 167838 | N/A | N/A |
| 436 | TXNRD2 | Y | 10587 | thioredoxin reductase 2, mitochondrial precursor | Thioredoxin reductase (TR) is a dimeric NADPH-dependent FAD containing enzyme that catalyzes the reduction of the active site disulfide of thioredoxin and other substrates. TR is a member of a family of pyridine nucleotide-disulfide oxidoreductases and is a key enzyme in the regulation of the intracellular redox environment. Three thioredoxin reductase genes have been found that encode selenocysteine containing proteins. This gene partially overlaps the COMT gene on chromosome 22. [provided by RefSeq, Oct 2011]. |
| 437 | TYR | N | 7299 | tyrosinase precursor | The enzyme encoded by this gene catalyzes the first 2 steps, and at least 1 subsequent step, in the conversion of tyrosine to melanin. The enzyme has both tyrosine hydroxylase and dopa oxidase catalytic activities, and requires copper for function. Mutations in this gene result in oculocutaneous albinism, and nonpathologic polymorphisms result in skin pigmentation variation. The human genome contains a pseudogene similar to the 3 half of this gene. [provided by RefSeq, Oct 2008]. |
| 438 | UFD1L | Y | 7353 | ubiquitin fusion degradation protein 1 homolog isoform B | The protein encoded by this gene forms a complex with two other proteins, nuclear protein localization-4 and valosin-containing protein, and this complex is necessary for the degradation of ubiquitinated proteins. In addition, this complex controls the disassembly of the mitotic spindle and the formation of a closed nuclear envelope after mitosis. Mutations in this gene have been associated with Catch 22 syndrome as well as cardiac and craniofacial defects. Alternative splicing results in multiple transcript variants encoding different isoforms. A related pseudogene has been identified on chromosome 18. [provided by RefSeq, Jun 2009]. Transcript Variant: This variant (2) uses an alternate splice site in the 3' coding region that results in a frameshift, compared to variant 1. The encoded isoform (B) has a distinct C-terminus and is shorter than isoform A. |

TABLE 3-continued

| Gene Number | Gene Name | Exon overlap | NCBI Gene ID | Gene Description | RefSeq Summmary |
|---|---|---|---|---|---|
| 439 | UGT2B15 | Y | 7366 | UDP-glucuronosyltransferase 2B15 precursor | This gene encodes a member of the UDP-glycosyltransferase (UDPGT) family. The UDPGTs are of major importance in the conjugation and subsequent elimination of potentially toxic xenobiotics and endogenous compounds. This protein displays activity towards several classes of xenobiotic substrates, including simple phenolic compounds, 7-hydroxylated coumarins, flavonoids, anthraquinones, and certain drugs and their hydroxylated metabolites. It also catalyzes the glucuronidation of endogenous estrogens and androgens. [provided by RefSeq, Oct 2011]. |
| 440 | UNC13C | N | 440279 | protein unc-13 homolog C | N/A |
| 441 | VPS13A | Y | 23230 | vacuolar protein sorting-associated protein 13A isoform B | The protein encoded by this gene may control steps in the cycling of proteins through the trans-Golgi network to endosomes, lysosomes and the plasma membrane. Mutations in this gene cause the autosomal recessive disorder, choreaacanthocytosis. Alternative splicing of this gene results in multiple transcript variants. [provided by RefSeq, Jul 2008]. Transcript Variant: This variant (B) contains a distinct 3'coding region and 3'UTR, compared to variant A. The resulting isoform (B) has a shorter C-terminus compared to isoform A. |
| 442 | WLS | N | 79971 | protein wntless homolog isoform 1 | N/A |
| 443 | WWOX | N | 51741 | WW domain-containing oxidoreductase isoform 3 | WW domain-containing proteins are found in all eukaryotes and play an important role in the regulation of a wide variety of cellular functions such as protein degradation, transcription, and RNA splicing. This gene encodes a protein which contains 2 WW domains and a short-chain dehydrogenase/reductase domain (SRD). The highest normal expression of this gene is detected in hormonally regulated tissues such as testis, ovary, and prostate. This expression pattern and the presence of an SRD domain suggest a role for this gene in steroid metabolism. The encoded protein is more than 90% identical to the mouse protein, which is an essential mediator of tumor necrosis factor-alpha-induced apoptosis, suggesting a similar, important role in apoptosis for the human protein. In addition, there is evidence that this gene behaves as a suppressor of tumor growth. Alternative splicing of this gene generates transcript variants that encode different isoforms. [provided by RefSeq, Jul 2008]. Transcript Variant: This variant (3) has a much shorter and alternate 3'end, as compared to variant 1. It encodes the shortest isoform (3) which contains only part of the first WW domain and lacks the second WW domain and the SRD region. |
| 444 | XG | Y | 7499 | glycoprotein Xg isoform 3 precursor | This gene encodes the XG blood group antigen, and is located at the pseudoautosomal boundary on the short (p) arm of chromosome X. The three 5' exons reside in the pseudoautosomal region and the remaining exons within the X-specific end. A truncated copy of this gene is found on the Y chromosome at the pseudoautosomal boundary. It is transcribed, but not expected to make a Y-chromosome specific gene product. Alternatively spliced transcript variants encoding different isoforms have been found for this gene. [provided by RefSeq, Nov 2008]. Transcript Variant: This variant (3) uses an alternate donor splice site at one of the coding exons compared to transcript variant 1, resulting in an isoform (3) containing one additional aa compared to isoform 1. Sequence Note: This RefSeq record was created from transcript and genomic sequence data because no quality transcript was available for the full length of the gene. The extent of this transcript is supported by transcript alignments. Sequence Note: This RefSeq record represents the XG*001.1.1 allele. |
| 445 | XYLB | both | 9942 | xylulose kinase | The protein encoded by this gene shares 22% sequence identity with Hemophilus influenzae xylulokinase, and even higher identity to other gene products in C.elegans (45%) and yeast (31-35%), which are thought to belong to a family of enzymes that include fucokinase, gluconokinase, glycerokinase and xylulokinase. These proteins play important roles in energy metabolism. [provided by RefSeq, Aug 2009]. |
| 446 | YAP1 | N | 10413 | yorkie homolog isoform 2 | This gene encodes the human ortholog of chicken YAP protein which binds to the SH3 domain of the Yes proto-oncogene product. This protein contains a WW domain that is found in various structural, regulatory and signaling molecules in yeast, nematode, and mammals, and may be involved in protein-protein interaction. [provided by RefSeq, Jul 2008]. Transcript Variant: This variant (2) lacks two alternate in-frame exons compared to variant 1. This results in a shorter protein (isoform 2), compared to isoform 1. Sequence Note: This RefSeq record was created from transcript and genomic sequence data to make the sequence consistent with the reference genome assembly. The genomic coordinates used for the transcript record were based on transcript alignments. |
| 447 | YPEL3 | Y | 83719 | protein yippee-like 3 isoform 1 | N/A |
| 448 | ZAN | Y | 7455 | zonadhesin isoform 6 precursor | This gene encodes a sperm membrane protein that binds the zona pellucida of the egg in a species-specific manner. The encoded protein may be involved in signaling or gamete recognition. Alternate transcriptional splice variants, encoding different isoforms, have been characterized. [provided by RefSeq, Jul 2008]. Transcript Variant: This variant (6) has |

TABLE 3-continued

| Gene Number | Gene Name | Exon overlap | NCBI Gene ID | Gene Description | RefSeq Summary |
|---|---|---|---|---|---|
| | | | | | multiple differences in the coding region but maintains the reading frame, compared to variant 3. This variant encodes isoform 6 which is 91 aa shorter than isoform 3. |
| 449 | ZBBX | N | 79740 | zinc finger B-box domain-containing protein 1 isoform 3 | N/A |
| 450 | ZC3H6 | N | 376940 | zinc finger CCCH domain-containing protein 6 | N/A |
| 451 | ZDHHC19 | Y | 131540 | probable palmitoyltransferase ZDHHC19 | N/A |
| 452 | ZDHHC8 | Y | 29801 | probable palmitoyltransferase ZDHHC8 isoform 2 | This gene encodes a four transmembrane protein that is a member of the zinc finger DHHC domain-containing protein family. The encoded protein may function as a palmitoyltransferase. Defects in this gene may be associated with a susceptibility to schizophrenia. Alternate splicing of this gene results in multiple transcript variants. A pseudogene of this gene is found on chromosome 22.[provided by RefSeq, May 2010]. Transcript Variant: This variant (2) uses an alternate splice site in the 3' coding region, which results in a frameshift, compared to variant 1. It encodes isoform 2, which has a shorter and distinct C-terminus, compared to isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| 453 | ZDHHC8 | both | 29801 | probable palmitoyltransferase ZDHHC8 isoform 2 | This gene encodes a four transmembrane protein that is a member of the zinc finger DHHC domain-containing protein family. The encoded protein may function as a palmitoyltransferase. Defects in this gene may be associated with a susceptibility to schizophrenia. Alternate splicing of this gene results in multiple transcript variants. A pseudogene of this gene is found on chromosome 22.[provided by RefSeq, May 2010]. Transcript Variant: This variant (2) uses an alternate splice site in the 3'coding region, which results in a frameshift, compared to variant 1. It encodes isoform 2, which has a shorter and distinct C-terminus, compared to isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| 454 | ZDHHC9 | N | 51114 | palmitoyltransferase ZDHHC9 | This gene encodes an integral membrane protein that is a member of the zinc finger DHHC domain-containing protein family. The encoded protein forms a complex with golgin subfamily A member 7 and functions as a palmitoyltransferase. This protein specifically palmitoylates HRAS and NRAS. Mutations in this gene are associated with X-linked mental retardation. Alternate splicing results in multiple transcript variants that encode the same protein. [provided by RefSeq, May 2010]. Transcript Variant: This variant (1) is the longer transcript and both variants 1 and 2 encode the same protein. Sequence Note: This RefSeq record was created from transcript and genomic sequence data to make the sequence consistent with the reference genome assembly. The genomic coordinates used for the transcript record were based on transcript alignments. |
| 455 | ZFP62 | Y | 643836 | zinc finger protein 62 homolog isoform 2 | N/A |
| 456 | ZG16 | Y | 653808 | zymogen granule membrane protein 16 precursor | N/A |
| 457 | ZMAT5 | Y | 55954 | zinc finger matrin-type protein 5 | N/A |
| 458 | ZNF174 | Y | 7727 | zinc finger protein 174 isoform b | N/A |
| 459 | ZNF434 | Y | 54925 | zinc finger protein 434 | N/A |
| 460 | ZNF486 | Y | 90649 | zinc finger protein 486 | N/A |
| 461 | ZNF597 | Y | 146434 | zinc finger protein 597 | N/A |

TABLE 3-continued

| Gene Number | Gene Name | Exon overlap | NCBI Gene ID | Gene Description | RefSeq Summmary |
|---|---|---|---|---|---|
| 462 | ZNF674 | Y | 641339 | zinc finger protein 674 isoform 2 | This gene encodes a zinc finger protein with an N-terminal Kruppel-associated box-containing (KRAB) domain and 11 Kruppel-type C2H2 zinc finger domains. Like other zinc finger proteins, this gene may function as a transcription factor. This gene resides on an area of chromosome X that has been implicated in nonsyndromic X-linked mental retardation. Alternative splicing results in multiple transcript variants encoding different isoforms. [provided by RefSeq, Jun 2010]. Transcript Variant: This variant (2) uses alternate in-frame donor and acceptor splice sites at two coding exons compared to variant 1, resulting in an isoform (2), which is 6 aa shorter than isoform 1. Sequence Note: This RefSeq record was created from transcript and genomic sequence data to make the sequence consistent with the reference genome assembly. The genomic coordinates used for the transcript record were based on transcript alignments. |
| 463 | ZNF737 | Y | 100129842 | zinc finger protein 737 | N/A |
| 464 | ZNF815 | Y | 401303 | N/A | N/A |
| 465 | ZNF862 | Y | 643641 | zinc finger protein 862 | N/A |
| 466 | ZNF890P | Y | 645700 | N/A | N/A |

TABLE 4

| Gene name | Exon overlap | SEQ ID No | RefSeq Accession Number | mRNA Description | RefSeq Summary |
|---|---|---|---|---|---|
| MIDN | Y | 884 | NM_177401 | *Homo sapiens* midnolin (MIDN), mRNA. | N/A |
| CSMD3 | N | 885 | NM_052900 | *Homo sapiens* CUB and Sushi multiple domains 3 (CSMD3), transcript variant c, mRNA. | N/A |
| CSMD3 | N | 886 | NM_198123 | *Homo sapiens* CUB and Sushi multiple domains 3 (CSMD3), transcript variant a, mRNA. | N/A |
| CSMD3 | N | 887 | NM_198124 | *Homo sapiens* CUB and Sushi multiple domains 3 (CSMD3), transcript variant b, mRNA. | N/A |
| DCC | N | 888 | NM_005215 | *Homo sapiens* deleted in colorectal carcinoma (DCC), mRNA. | This gene encodes a netrin 1 receptor. The transmembrane protein is a member of the immunoglobulin superfamily of cell adhesion molecules, and mediates axon guidance of neuronal growth cones towards sources of netrin 1 ligand. The cytoplasmic tail interacts with the tyrosine kinases Src and focal adhesion kinase (FAK, also known as PTK2) to mediate axon attraction. The protein partially localizes to lipid rafts, and induces apoptosis in the absence of ligand. The protein functions as a tumor suppressor, and is frequently mutated or downregulated in colorectal cancer and esophageal carcinoma. [provided by RefSeq, October 2009]. Sequence Note: This RefSeq record was created from transcript and genomic sequence data to make the sequence consistent with the reference genome assembly. The genomic coordinates used for the transcript record were based on transcript alignments. |
| CLSTN1 | N | 889 | NM_001009566 | *Homo sapiens* calsyntenin 1 (CLSTN1), transcript variant 1, mRNA. | N/A |
| CLSTN1 | N | 890 | NM_014944 | *Homo sapiens* calsyntenin 1 (CLSTN1), transcript variant 2, mRNA. | N/A |
| ANKRD33B | N | 891 | NM_001164440 | *Homo sapiens* ankyrin repeat domain 33B (ANKRD33B), mRNA. | N/A |
| CTNND2 | Y | 892 | NM_001332 | *Homo sapiens* catenin (cadherin-associated protein), delta 2 (neural plakophilin-related arm-repeat protein) (CTNND2), mRNA. | This gene encodes an adhesive junction associated protein of the armadillo/beta-catenin superfamily and is implicated in brain and eye development and cancer formation. The protein encoded by this gene promotes the disruption of E-cadherin based adherens junction to favor cell spreading upon stimulation by hepatocyte growth factor. This gene is overexpressed in prostate adenocarcinomas and is associated with decreased expression of tumor suppressor E-cadherin in this tissue. This gene resides in a region of the short arm of chromosome 5 that is deleted in Cri du Chat syndrome. [provided by RefSeq, August 2010]. |
| FRG1B | Y | 893 | NR_003579 | *Homo sapiens* FSHD region gene 1 family, member B (FRG1B), non-coding RNA. | N/A |
| LILRB3 | Y | 894 | NM_001081450 | *Homo sapiens* leukocyte immunoglobulin-like receptor, subfamily B (with TM and ITIM domains), | This gene is a member of the leukocyte immunoglobulin-like receptor (LIR) family, which is found in a gene cluster at chromosomal region 19q13.4. The encoded protein belongs to the subfamily B class of LIR receptors which contain two or four extracellular immunoglobulin domains, a transmembrane domain, and two to four cytoplasmic immunoreceptor tyrosine-based inhibitory motifs (ITIMs). The |

TABLE 4-continued

| Gene name | Exon overlap | SEQ ID No | RefSeq Accession Number | mRNA Description | RefSeq Summary |
|---|---|---|---|---|---|
| | | | | | receptor is expressed on immune cells where it binds to MHC class I molecules on antigen-presenting cells and transduces a negative signal that inhibits stimulation of an immune response. It is thought to control inflammatory responses and cytotoxicity to help focus the immune response and limit autoreactivity. Multiple transcript variants encoding different isoforms have been found for this gene. [provided by RefSeq, July 2008]. Transcript Variant: This variant (1) represents the longer transcript and encodes the longer isoform (1). |
| LILRB3 | Y | 895 | NM_006864 | Homo sapiens leukocyte immunoglobulin-like receptor, subfamily B (with TM and ITIM domains), member 3 (LILRB3), transcript variant 2, mRNA. | This gene is a member of the leukocyte immunoglobulin-like receptor (LIR) family, which is found in a gene cluster at chromosomal region 19q13.4. The encoded protein belongs to the subfamily B class of LIR receptors which contain two or four extracellular immunoglobulin domains, a transmembrane domain, and two to four cytoplasmic immunoreceptor tyrosine-based inhibitory motifs (ITIMs). The receptor is expressed on immune cells where it binds to MHC class I molecules on antigen-presenting cells and transduces a negative signal that inhibits stimulation of an immune response. It is thought to control inflammatory responses and cytotoxicity to help focus the immune response and limit autoreactivity. Multiple transcript variants encoding different isoforms have been found for this gene. [provided by RefSeq, July 2008]. Transcript Variant: This variant (2) uses an alternate in-frame splice site in the 3' coding region, compared to variant 1. The resulting protein (isoform 2) is 1 aa shorter than isoform 1. |
| NRG1 | N | 896 | NM_001159995 | Homo sapiens neuregulin 1 (NRG1), transcript variant HRG-beta1c, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (HRG-beta1c) has an alternate 5' exon and lacks an internal exon, compared to variant HRG-beta1. The resulting isoform (HRG-beta1c, also known as type IV fetal C beta 1a and fetal b IV-beta 1a) is shorter, and has a different N-terminus and lacks an internal segment, compared to isoform HRG-beta1. |
| NRG1 | N | 897 | NM_001159996 | Homo sapiens neuregulin 1 (NRG1), transcript variant ndf43c, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (ndf43c, also known as ndf43) lacks multiple 5' exons, but has an alternate 5' exon, an alternate internal segment and an additional exon in the 3' region, compared to variant HRG-beta1. The resulting isoform (ndf43c) is much shorter, and has alternate N- and C-termini and a different internal segment, compared to isoform HRG-beta1. |
| NRG1 | N | 898 | NM_001159999 | Homo sapiens neuregulin 1 (NRG1), transcript variant HRG-beta1b, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript |

TABLE 4-continued

| Gene name | Exon overlap | SEQ ID No | RefSeq Accession Number | mRNA Description | RefSeq Summary |
|---|---|---|---|---|---|
| NRG1 | N | 899 | NM_001160001 | *Homo sapiens* neuregulin 1 (NRG1), transcript variant HRG-beta1d, mRNA. | Variant: This variant (HRG-beta1b) has an alternate 5' exon, compared to variant HRG-beta1. The resulting isoform (HRG-beta1b, also known as type IV fetal B beta 1a) is shorter, and has a different N-terminus, compared to isoform HRG-beta1. The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (HRG-beta1d) has an alternate 5' exon and lacks two internal exons, compared to variant HRG-beta1. The resulting isoform (HRG-beta1d, also known as IV-beta 1a and type IV fetal A beta 1a) is shorter, and has a different N-terminus and lacks an internal segment, compared to isoform HRG-beta1. |
| NRG1 | N | 900 | NM_001160002 | *Homo sapiens* neuregulin 1 (NRG1), transcript variant HRG-gamma2, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (HRG-gamma2) lacks an internal exon, and has an alternate 3' UTR, compared to variant HRG-beta1. The resulting isoform (HRG-gamma2, also known as gamma protein isoform 1) lacks an internal segment and is C-terminal truncated, compared to isoform HRG-beta1. Sequence Note: This RefSeq record was created from transcript and genomic sequence data to make the sequence consistent with the reference genome assembly. The genomic coordinates used for the transcript record were based on transcript alignments. |
| NRG1 | N | 901 | NM_001160004 | *Homo sapiens* neuregulin 1 (NRG1), transcript variant ndf43b, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (ndf43b, also called ndf43-beta2) lacks an internal exon, but has an additional exon in the 3' coding region, compared to variant HRG-beta1. The resulting isoform (ndf43b) is shorter, and lacks an internal segment and has a different C-terminus, compared to isoform HRG-beta1. Sequence Note: This RefSeq record was created from transcript and genomic sequence data to make the sequence consistent with the reference genome assembly. The genomic coordinates used for the transcript record were based on transcript alignments. |
| NRG1 | N | 902 | NM_001160005 | *Homo sapiens* neuregulin 1 (NRG1), transcript variant HRG-beta3b, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms |

TABLE 4-continued

| Gene name | Exon overlap | SEQ ID No | RefSeq Accession Number | mRNA Description | RefSeq Summary |
|---|---|---|---|---|---|
| | | | | | are classified into types I, II, III, IV, V and VI. The gene dysregulation has been linked to diseases such as cancer, schizophrenia and bipolar disorder (BPD). [provided by RefSeq, May 2009]. Transcript Variant: This variant (HRG-beta3b) lacks two internal exons and multiple 3' exons, and has an alternate 3' sequence including the coding region and UTR, compared to variant HRG-beta1. The resulting isoform (HRG-beta3b, also known as HRG-beta 3 protein isoform) is much shorter, and lacks an internal segment and has a different C-terminus, compared to isoform HRG-beta1. Sequence Note: This RefSeq record was created from transcript and genomic sequence data to make the sequence consistent with the reference genome assembly. The genomic coordinates used for the transcript record were based on transcript alignments. |
| NRG1 | N | 903 | NM_001160007 | Homo sapiens neuregulin 1 (NRG1), transcript variant HRG-gamma3, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (HRG-gamma3) lacks two internal exons and multiple 3' exons, and has an alternate 3' UTR, compared to variant HRG-beta1. The resulting isoform (HRG-gamma3, also known as gamma protein isoform 2) lacks an internal segment and is C-terminal truncated, compared to isoform HRG-beta1. Sequence Note: This RefSeq record was created from transcript and genomic sequence data to make the sequence consistent with the reference genome assembly. The genomic coordinates used for the transcript record were based on transcript alignments. |
| NRG1 | N | 904 | NM_001160008 | Homo sapiens neuregulin 1 (NRG1), transcript variant HRG-beta2b, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (HRG-beta2b) lacks an internal exon and the 3' exon, but has an alternate 3' UTR, compared to variant HRG-beta1. The resulting isoform (HRG-beta2b) lacks an internal segment and is C-terminal truncated, compared to isoform HRG-beta1. |
| NRG1 | N | 905 | NM_004495 | Homo sapiens neuregulin 1 (NRG1), transcript variant HRG-gamma, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (HRG-gamma) lacks multiple 3' exons and has an alternate 3' UTR, compared to variant HRG-beta1. The resulting isoform (HRG-gamma) is C-terminal truncated, compared to isoform HRG-beta1. Sequence Note: This RefSeq record was created from transcript and genomic sequence data to make the sequence consistent with the reference genome assembly. The genomic coordinates used for the transcript record were based on transcript alignments. |

TABLE 4-continued

| Gene name | Exon overlap | SEQ ID No | RefSeq Accession Number | mRNA Description | RefSeq Summary |
|---|---|---|---|---|---|
| NRG1 | N | 906 | NM_013956 | *Homo sapiens* neuregulin 1 (NRG1), transcript variant HRG-beta1, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (HRG-beta1) is the longest transcript and encodes the longest isoform (HRG-beta1). |
| NRG1 | N | 907 | NM_013957 | *Homo sapiens* neuregulin 1 (NRG1), transcript variant HRG-beta2, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (HRG-beta2) lacks an internal exon in the 3' coding region, compared to variant HRG-beta1. The resulting isoform (HRG-beta2) has identical N- and C-termini, but lacks an internal segment, compared to isoform HRG-beta1. |
| NRG1 | N | 908 | NM_013958 | *Homo sapiens* neuregulin 1 (NRG1), transcript variant HRG-beta3, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (HRG-beta3), also known as GGF or (3GFHFB1) lacks multiple 3' exons, and has an alternate 3' sequence including the coding region and UTR, compared to variant HRG-beta1. The resulting isoform (HRG-beta3) is much shorter, and has a different C-terminus, compared to isoform HRG-beta1. |
| NRG1 | N | 909 | NM_013959 | *Homo sapiens* neuregulin 1 (NRG1), transcript variant SMDF, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (SMDF) is expressed mainly in the nervous system. It lacks multiple 5' and 3' exons, but has an alternate 5' exon and an alternate 3' sequence including the coding region and UTR, compared to variant HRG-beta1. The resulting isoform (SMDF) is much shorter, and has different N- and C-termini, compared to isoform HRG-beta1. |
| NRG1 | N | 910 | NM_013960 | *Homo sapiens* neuregulin 1 (NRG1), transcript variant ndf43, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different |

TABLE 4-continued

| Gene name | Exon overlap | SEQ ID No | RefSeq Accession Number | mRNA Description | RefSeq Summary |
|---|---|---|---|---|---|
| | | | | | isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (ndf43) has an alternate internal segment and an additional exon in the 3' region, compared to variant HRG-beta1. The resulting isoform (ndf43) is shorter, and has a different internal segment and C-terminus, compared to isoform HRG-beta1. |
| NRG1 | N | 911 | NM_013962 | Homo sapiens neuregulin 1 (NRG1), transcript variant GGF2, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (GGF2, also called GGFHBS5) is expressed in the nervous system and functions as a neuronal signal that promotes the proliferation and survival of the oligodendrocyte and the myelinating cell. This variant lacks two internal exons and multiple 3' exons, and has an alternate 5' exon and an alternate 3' sequence including the coding region and UTR, compared to variant HRG-beta1. The resulting isoform (GGF2) is shorter, and has different N- and C- termini as well as lacks an internal segment, compared to isoform HRG-beta1. |
| NRG1 | N | 912 | NM_013964 | Homo sapiens neuregulin 1 (NRG1), transcript variant HRG-alpha, mRNA. | The protein encoded by this gene was originally identified as a 44-kD glycoprotein that interacts with the NEU/ERBB2 receptor tyrosine kinase to increase its phosphorylation on tyrosine residues. This protein is a signaling protein that mediates cell-cell interactions and plays critical roles in the growth and development of multiple organ systems. It is known that an extraordinary variety of different isoforms are produced from this gene through alternative promoter usage and splicing. These isoforms are tissue-specifically expressed and differ significantly in their structure, and thereby these isoforms are classified into types I, II, III, IV, V and VI. The gene dysregulation has been linked to diseases such as cancer, schizophrenia and bipolar disorder (BPD). [provided by RefSeq, May 2009]. Transcript Variant: This variant (HRG-alpha, also called erbB2) has an alternate internal segment, compared to variant HRG-beta1. The resulting isoform (HRG-alpha) is shorter, and has identical N- and C-termini and a different internal segment, compared to isoform HRG-beta1. |
| OR52E8 | Y | 913 | NM_001005168 | Homo sapiens olfactory receptor, family 52, subfamily E, member 8 (OR52E8), mRNA. | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, July 2008]. |
| SMOC2 | N | 914 | NM_001166412 | Homo sapiens SPARC related modular calcium binding 2 (SMOC2), transcript variant 2, mRNA. | This gene encodes a member of the SPARC family (secreted protein acidic and rich in cysteine/osteonectin/BM-40), which are highly expressed during embryogenesis and wound healing. The gene product is a matricellular protein which promotes matrix assembly and can stimulate endothelial cell proliferation and migration, as well as angiogenic activity. Associated with pulmonary function, this secretory gene product contains a Kazal domain, two thymoglobulin type-1 domains, and two EF-hand calcium-binding domains. The encoded protein may serve as a target for controlling angiogenesis in tumor growth and myocardial ischemia. Alternative splicing results in multiple transcript variants. [provided by RefSeq, October 2009]. Transcript Variant: This variant (2) uses an |

TABLE 4-continued

| Gene name | Exon overlap | SEQ ID No | RefSeq Accession Number | mRNA Description | RefSeq Summary |
|---|---|---|---|---|---|
| SMOC2 | N | 915 | NM_022138 | *Homo sapiens* SPARC related modular calcium binding 2 (SMOC2), transcript variant 1, mRNA. | alternate in-frame splice site in the central coding region, compared to variant 1. This results in a shorter protein (isoform 2), compared to isoform 1. This gene encodes a member of the SPARC family (secreted protein acidic and rich in cysteine/osteonectin/BM-40), which are highly expressed during embryogenesis and wound healing. The gene product is a matricellular protein which promotes matrix assembly and can stimulate endothelial cell proliferation and migration, as well as angiogenic activity. Associated with pulmonary function, this secretory gene product contains a Kazal domain, two thymoglobulin type-1 domains, and two EF-hand calcium-binding domains. The encoded protein may serve as a target for controlling angiogenesis in tumor growth and myocardial ischemia. Alternative splicing results in multiple transcript variants. [provided by RefSeq, October 2009]. Transcript Variant: This variant (1) represents the longer transcript and encodes the longer isoform (1). |
| APBA1 | Y | 916 | NM_001163 | *Homo sapiens* amyloid beta (A4) precursor protein-binding, family A, member 1 (APBA1), mRNA. | The protein encoded by this gene is a member of the X11 protein family. It is a neuronal adapter protein that interacts with the Alzheimer's disease amyloid precursor protein (APP). It stabilizes APP and inhibits production of proteolytic APP fragments including the A beta peptide that is deposited in the brains of Alzheimer's disease patients. This gene product is believed to be involved in signal transduction processes. It is also regarded as a putative vesicular trafficking protein in the brain that can form a complex with the potential to couple synaptic vesicle exocytosis to neuronal cell adhesion. [provided by RefSeq, July 2008]. |
| LRRTM4 | N | 917 | NM_001134745 | *Homo sapiens* leucine rich repeat transmembrane neuronal 4 (LRRTM4), transcript variant 1, mRNA. | N/A |
| LRRTM4 | N | 918 | NM_024993 | *Homo sapiens* leucine rich repeat transmembrane neuronal 4 (LRRTM4), transcript variant 2, mRNA. | N/A |
| SGK1 | N | 919 | NM_001143676 | *Homo sapiens* serum/glucocorticoid regulated kinase 1 (SGK1), transcript variant 2, mRNA. | This gene encodes a serine/threonine protein kinase that plays an important role in cellular stress response. This kinase activates certain potassium, sodium, and chloride channels, suggesting an involvement in the regulation of processes such as cell survival, neuronal excitability, and renal sodium excretion. High levels of expression of this gene may contribute to conditions such as hypertension and diabetic nephropathy. Several alternatively spliced transcript variants encoding different isoforms have been noted for this gene. [provided by RefSeq, January 2009]. Transcript Variant: This variant (2) contains additional in-frame exons at the 5' end compared to transcript variant 1, resulting in an isoform (2) with a longer and an unique N-terminus compared to isoform 1. Isoform 2 is reported to have an increased protein half-life, and is preferentially targeted to the plasma membrane. |
| SGK1 | N | 920 | NM_001143677 | *Homo sapiens* serum/glucocorticoid regulated kinase 1 (SGK1), transcript variant 3, mRNA. | This gene encodes a serine/threonine protein kinase that plays an important role in cellular stress response. This kinase activates certain potassium, sodium, and chloride channels, suggesting an involvement in the regulation of processes such as cell survival, neuronal excitability, and renal sodium excretion. High levels of expression of this gene may contribute to conditions such as hypertension and diabetic nephropathy. Several alternatively spliced transcript variants encoding different isoforms have been noted for this gene. [provided by RefSeq, January 2009]. Transcript Variant: This variant (3) contains an alternative in-frame, 5' terminal exon compared to transcript variant 1, resulting in an isoform (3) with a longer and an unique N-terminus compared to isoform 1. |
| SGK1 | N | 921 | NM_001143678 | *Homo sapiens* serum/glucocorticoid regulated kinase 1 (SGK1), transcript variant 4, mRNA. | This gene encodes a serine/threonine protein kinase that plays an important role in cellular stress response. This kinase activates certain potassium, sodium, and chloride channels, suggesting an involvement in the regulation of processes such as cell survival, neuronal excitability, and renal sodium excretion. High levels of expression of this gene may contribute to conditions such as hypertension and diabetic nephropathy. Several alternatively spliced transcript variants encoding different isoforms have been noted for this gene. [provided by RefSeq, January 2009]. Transcript Variant: |

TABLE 4-continued

| Gene name | Exon overlap | SEQ ID No | RefSeq Accession Number | mRNA Description | RefSeq Summary |
|---|---|---|---|---|---|
| SGK1 | N | 922 | NM_005627 | Homo sapiens serum/glucocorticoid regulated kinase 1 (SGK1), transcript variant 1, mRNA | This variant (4) contains an alternative in-frame, 5' terminal exon compared to transcript variant 1, resulting in an isoform (4) with a longer and an unique N-terminus compared to isoform 1. This gene encodes a serine/threonine protein kinase that plays an important role in cellular stress response. This kinase activates certain potassium, sodium, and chloride channels, suggesting an involvement in the regulation of processes such as cell survival, neuronal excitability, and renal sodium excretion. High levels of expression of this gene may contribute to conditions such as hypertension and diabetic nephropathy. Several alternatively spliced transcript variants encoding different isoforms have been noted for this gene. [provided by RefSeq, January 2009]. Transcript Variant: This variant (1) represents the predominant transcript and encodes the shortest isoform (1). |
| MTRNR2L1 | Y | 923 | NM_001190452 | Homo sapiens MT-RNR2-like 1 (MTRNR2L1), mRNA. | N/A |
| MTRNR2L5 | Y | 924 | NM_001190478 | Homo sapiens MT-RNR2-like 5 (MTRNR2L5), mRNA. | N/A |
| PCDH15 | N | 925 | NM_001142763 | Homo sapiens protocadherin-related 15 (PCDH15), transcript variant A, mRNA. | This gene is a member of the cadherin superfamily. Family members encode integral membrane proteins that mediate calcium-dependent cell-cell adhesion. It plays an essential role in maintenance of normal retinal and cochlear function. Mutations in this gene result in hearing loss and Usher Syndrome Type IF (USH1F). Extensive alternative splicing resulting in multiple isoforms has been observed in the mouse ortholog. Similar alternatively spliced transcripts are inferred to occur in human, and additional variants are likely to occur. [provided by RefSeq, December 2008]. Transcript Variant: This variant (A) encodes isoform CD1-1. Sequence Note: The RefSeq transcript and protein were derived from genomic sequence to make the sequence consistent with the reference genome assembly. The genomic coordinates used for the transcript record were based on orthologous data. Publication Note: This RefSeq record includes a subset of the publications that are available for this gene. Please see the Gene record to access additional publications. |
| PCDH15 | N | 926 | NM_001142764 | Homo sapiens protocadherin-related 15 (PCDH15), transcript variant B, mRNA. | This gene is a member of the cadherin superfamily. Family members encode integral membrane proteins that mediate calcium-dependent cell-cell adhesion. It plays an essential role in maintenance of normal retinal and cochlear function. Mutations in this gene result in hearing loss and Usher Syndrome Type IF (USH1F). Extensive alternative splicing resulting in multiple isoforms has been observed in the mouse ortholog. Similar alternatively spliced transcripts are inferred to occur in human, and additional variants are likely to occur. [provided by RefSeq, December 2008]. Transcript Variant: This variant (B) lacks an alternate in-frame exon in the 5' coding region, compared to variant A. The resulting isoform (CD1-2) lacks a 5-aa segment near the N-terminus, compared to isoform CD1-1. Sequence Note: The RefSeq transcript and protein were derived from genomic sequence to make the sequence consistent with the reference genome assembly. The genomic coordinates used for the transcript record were based on orthologous data. Publication Note: This RefSeq record includes a subset of the publications that are available for this gene. Please see the Gene record to access additional publications. |
| PCDH15 | N | 927 | NM_001142765 | Homo sapiens protocadherin-related 15 (PCDH15), transcript variant D, mRNA. | This gene is a member of the cadherin superfamily. Family members encode integral membrane proteins that mediate calcium-dependent cell-cell adhesion. It plays an essential role in maintenance of normal retinal and cochlear function. Mutations in this gene result in hearing loss and Usher Syndrome Type IF (USH1F). Extensive alternative splicing resulting in multiple isoforms has been observed in the mouse ortholog. Similar alternatively spliced transcripts are inferred to occur in human, and additional variants are likely to occur. [provided by RefSeq, December 2008]. Transcript Variant: This variant (D) lacks an alternate in-frame exon in the 5' coding region and two alternate in-frame exons in the central coding region, compared to variant A. The resulting isoform (CD1-6) lacks a 5-aa segment near the N-terminus and a 71-aa segment in the central protein, compared to isoform CD1-1. Sequence Note: The RefSeq transcript and protein were derived from genomic sequence to make the sequence |

TABLE 4-continued

| Gene name | Exon overlap | SEQ ID No | RefSeq Accession Number | mRNA Description | RefSeq Summary |
|---|---|---|---|---|---|
| | | | | | consistent with the reference genome assembly. The genomic coordinates used for the transcript record were based on orthologous data. Publication Note: This RefSeq record includes a subset of the publications that are available for this gene. Please see the Gene record to access additional publications. |
| PCDH15 | N | 928 | NM_001142766 | *Homo sapiens* protocadherin-related 15 (PCDH15), transcript variant E, mRNA. | This gene is a member of the cadherin superfamily. Family members encode integral membrane proteins that mediate calcium-dependent cell-cell adhesion. It plays an essential role in maintenance of normal retinal and cochlear function. Mutations in this gene result in hearing loss and Usher Syndrome Type IF (USH1F). Extensive alternative splicing resulting in multiple isoforms has been observed in the mouse ortholog. Similar alternatively spliced transcripts are inferred to occur in human, and additional variants are likely to occur. [provided by RefSeq, December 2008]. Transcript Variant: This variant (E) lacks three alternate in-frame exons, compared to variant A. The resulting isoform (CD1-7) has the same N- and C-termini but lacks three internal segments, compared to isoform CD1-1. Sequence Note: The RefSeq transcript and protein were derived from genomic sequence to make the sequence consistent with the reference genome assembly. The genomic coordinates used for the transcript record were based on orthologous data. Publication Note: This RefSeq record includes a subset of the publications that are available for this gene. Please see the Gene record to access additional publications. |
| PCDH15 | N | 929 | NM_001142767 | *Homo sapiens* protocadherin-related 15 (PCDH15), transcript variant F, mRNA. | This gene is a member of the cadherin superfamily. Family members encode integral membrane proteins that mediate calcium-dependent cell-cell adhesion. It plays an essential role in maintenance of normal retinal and cochlear function. Mutations in this gene result in hearing loss and Usher Syndrome Type IF (USH1F). Extensive alternative splicing resulting in multiple isoforms has been observed in the mouse ortholog. Similar alternatively spliced transcripts are inferred to occur in human, and additional variants are likely to occur. [provided by RefSeq, December 2008]. Transcript Variant: This variant (F) lacks 4 alternate in-frame exons, compared to variant A. The resulting isoform (CD1-8) has the same N- and C-termini but lacks four internal segments, compared to isoform CD1-1. Sequence Note: The RefSeq transcript and protein were derived from genomic sequence to make the sequence consistent with the reference genome assembly. The genomic coordinates used for the transcript record were based on orthologous data. Publication Note: This RefSeq record includes a subset of the publications that are available for this gene. Please see the Gene record to access additional publications. |
| PCDH15 | N | 930 | NM_001142768 | *Homo sapiens* protocadherin-related 15 (PCDH15), transcript variant G, mRNA. | This gene is a member of the cadherin superfamily. Family members encode integral membrane proteins that mediate calcium-dependent cell-cell adhesion. It plays an essential role in maintenance of normal retinal and cochlear function. Mutations in this gene result in hearing loss and Usher Syndrome Type IF (USH1F). Extensive alternative splicing resulting in multiple isoforms has been observed in the mouse ortholog. Similar alternatively spliced transcripts are inferred to occur in human, and additional variants are likely to occur. [provided by RefSeq, December 2008]. Transcript Variant: This variant (G) lacks two alternate in-frame exons in the 5' coding region, compared to variant A. The resulting isoform (CD1-9) lacks a 27-aa segment near the N-terminus, compared to isoform CD1-1. Sequence Note: The RefSeq transcript and protein were derived from genomic sequence to make the sequence consistent with the reference genome assembly. The genomic coordinates used for the transcript record were based on orthologous data. Publication Note: This RefSeq record includes a subset of the publications that are available for this gene. Please see the Gene record to access additional publications. |
| PCDH15 | N | 931 | NM_001142769 | *Homo sapiens* protocadherin-related 15 (PCDH15), transcript variant I, mRNA. | This gene is a member of the cadherin superfamily. Family members encode integral membrane proteins that mediate calcium-dependent cell-cell adhesion. It plays an essential role in maintenance of normal retinal and cochlear function. Mutations in this gene result in hearing loss and Usher Syndrome Type IF (USH1F). Extensive alternative splicing resulting in multiple isoforms has been observed in the mouse ortholog. Similar alternatively spliced transcripts are inferred to occur in human, and additional variants are likely to occur. [provided by RefSeq, December 2008]. Transcript Variant: This |

TABLE 4-continued

| Gene name | Exon overlap | SEQ ID No | RefSeq Accession Number | mRNA Description | RefSeq Summary |
|---|---|---|---|---|---|
| PCDH15 | N | 932 | NM_001142770 | Homo sapiens protocadherin-related 15 (PCDH15), transcript variant J, mRNA. | variant (I) includes an alternate in-frame exon in the central coding region and has a distinct 3' splice pattern, compared to variant A. The resulting isoform (CD2-1) includes an alternate 7-aa segment in the central coding region and has a distinct and longer C-terminus, compared to isoform CD1-1. Sequence Note: The RefSeq transcript and protein were derived from genomic sequence to make the sequence consistent with the reference genome assembly. The genomic coordinates used for the transcript record were based on orthologous data. Publication Note: This RefSeq record includes a subset of the publications that are available for this gene. Please see the Gene record to access additional publications. This gene is a member of the cadherin superfamily. Family members encode integral membrane proteins that mediate calcium-dependent cell-cell adhesion. It plays an essential role in maintenance of normal retinal and cochlear function. Mutations in this gene result in hearing loss and Usher Syndrome Type IF (USH1F). Extensive alternative splicing resulting in multiple isoforms has been observed in the mouse ortholog. Similar alternatively spliced transcripts are inferred to occur in human, and additional variants are likely to occur. [provided by RefSeq, December 2008]. Transcript Variant: This variant (J) lacks an alternate in-frame exon in the 5' coding region and has a distinct 3' splice pattern, compared to variant A. The resulting isoform (CD2-2) lacks a 5-aa segment in the 5' coding region and has a distinct and longer C-terminus, compared to isoform CD1-1. Sequence Note: The RefSeq transcript and protein were derived from genomic sequence to make the sequence consistent with the reference genome assembly. The genomic coordinates used for the transcript record were based on orthologous data. Publication Note: This RefSeq record includes a subset of the publications that are available for this gene. Please see the Gene record to access additional publications. |
| PCDH15 | N | 933 | NM_001142771 | Homo sapiens protocadherin-related 15 (PCDH15), transcript variant K, mRNA. | This gene is a member of the cadherin superfamily. Family members encode integral membrane proteins that mediate calcium-dependent cell-cell adhesion. It plays an essential role in maintenance of normal retinal and cochlear function. Mutations in this gene result in hearing loss and Usher Syndrome Type IF (USH1F). Extensive alternative splicing resulting in multiple isoforms has been observed in the mouse ortholog. Similar alternatively spliced transcripts are inferred to occur in human, and additional variants are likely to occur. [provided by RefSeq, December 2008]. Transcript Variant: This variant (K) has a distinct 3' splice pattern, compared to variant A. The resulting isoform (CD3-1) has a distinct and longer C-terminus, compared to isoform CD1-1. Sequence Note: The RefSeq transcript and protein were derived from genomic sequence to make the sequence consistent with the reference genome assembly. The genomic coordinates used for the transcript record were based on orthologous data. Publication Note: This RefSeq record includes a subset of the publications that are available for this gene. Please see the Gene record to access additional publications. |
| PCDH15 | N | 934 | NM_001142772 | Homo sapiens protocadherin-related 15 (PCDH15), transcript variant L, mRNA. | This gene is a member of the cadherin superfamily. Family members encode integral membrane proteins that mediate calcium-dependent cell-cell adhesion. It plays an essential role in maintenance of normal retinal and cochlear function. Mutations in this gene result in hearing loss and Usher Syndrome Type IF (USH1F). Extensive alternative splicing resulting in multiple isoforms has been observed in the mouse ortholog. Similar alternatively spliced transcripts are inferred to occur in human, and additional variants are likely to occur. [provided by RefSeq, December 2008]. Transcript Variant: This variant (L) lacks an alternate in-frame exon in the 5' coding region and has a distinct 3' splice pattern, compared to variant A. The resulting isoform (CD3-2) lacks a 5-aa segment near the N-terminus and has a distinct and longer C-terminus, compared to isoform CD1-1. Sequence Note: The RefSeq transcript and protein were derived from genomic sequence to make the sequence consistent with the reference genome assembly. The genomic coordinates used for the transcript record were based on orthologous data. Publication Note: This RefSeq record includes a subset of the publications that are available for this gene. Please see the Gene record to access additional publications. |
| PCDH15 | N | 935 | NM_001142773 | Homo sapiens protocadherin-related 15 (PCDH15), transcript | This gene is a member of the cadherin superfamily. Family members encode integral membrane proteins that mediate calcium-dependent cell-cell adhesion. It plays an essential role in maintenance of normal retinal and cochlear function. Mutations in this gene result in hearing loss and Usher Syndrome |

TABLE 4-continued

| Gene name | Exon overlap | SEQ ID No | RefSeq Accession Number | mRNA Description | RefSeq Summary |
|---|---|---|---|---|---|
| | | | | variant H, mRNA. | Type IF (USH1F). Extensive alternative splicing resulting in multiple isoforms has been observed in the mouse ortholog. Similar alternatively spliced transcripts are inferred to occur in human, and additional variants are likely to occur. [provided by RefSeq, December 2008]. Transcript Variant: This variant (H) lacks three alternate in-frame exons, compared to variant A. The resulting isoform (CD1-10) has the same N- and C-termini but lacks two internal segments, compared to isoform CD1-10. Sequence Note: The RefSeq transcript and protein were derived from genomic sequence to make the sequence consistent with the reference genome assembly. The genomic coordinates used for the transcript record were based on orthologous data. Publication Note: This RefSeq record includes a subset of the publications that are available for this gene. Please see the Gene record to access additional publications. |
| PCDH15 | N | 936 | NM_033056 | Homo sapiens protocadherin-related 15 (PCDH15), transcript variant C, mRNA. | This gene is a member of the cadherin superfamily. Family members encode integral membrane proteins that mediate calcium-dependent cell-cell adhesion. It plays an essential role in maintenance of normal retinal and cochlear function. Mutations in this gene result in hearing loss and Usher Syndrome Type IF (USH1F). Extensive alternative splicing resulting in multiple isoforms has been observed in the mouse ortholog. Similar alternatively spliced transcripts are inferred to occur in human, and additional variants are likely to occur. [provided by RefSeq, December 2008]. Transcript Variant: This variant (C) lacks two alternate in-frame exons in the 5' and 3' coding region, compared to variant A. The resulting isoform (CD1-4) lacks a 5-aa segment near the N-terminus and a 2-aa segment near the C-terminus, compared to isoform CD1-1. Publication Note: This RefSeq record includes a subset of the publications that are available for this gene. Please see the Gene record to access additional publications. |
| ADM | Y | 937 | NM_001124 | Homo sapiens adrenomedullin (ADM), mRNA. | Adrenomedullin, a hypotensive peptide found in human pheochromocytoma, consists of 52 amino acids, has 1 intramolecular disulfide bond, and shows a slight homology with the calcitonin gene-related peptide. It may function as a hormone in circulation control because it is found in blood in a considerable concentration. The precursor, called preproadrenomedullin, is 185 amino acids long. By RNA-blot analysis, human adrenomedullin mRNA was found to be highly expressed in several tissues. Genomic ADM DNA consists of 4 exons and 3 introns, with the 5-prime flanking region containing TATA, CAAT, and GC boxes. There are also multiple binding sites for activator protein-2 and a cAMP-regulated enhancer element. [provided by RefSeq, July 2008]. |
| AMPD3 | Y | 938 | NM_000480 | Homo sapiens adenosine monophosphate deaminase 3 (AMPD3), transcript variant 1, mRNA. | This gene encodes a member of the AMP deaminase gene family. The encoded protein is a highly regulated enzyme that catalyzes the hydrolytic deamination of adenosine monophosphate to inosine monophosphate, a branch point in the adenylate catabolic pathway. This gene encodes the erythrocyte (E) isoforms, whereas other family members encode isoforms that predominate in muscle (M) and liver (L) cells. Mutations in this gene lead to the clinically asymptomatic, autosomal recessive condition erythrocyte AMP deaminase deficiency. Alternatively spliced transcript variants encoding different isoforms of this gene have been described. [provided by RefSeq, July 2008]. Transcript Variant: This variant (1) encodes the longest isoform (1A). |
| AMPD3 | Y | 939 | NM_001025389 | Homo sapiens adenosine monophosphate deaminase 3 (AMPD3), transcript variant 2, mRNA. | This gene encodes a member of the AMP deaminase gene family. The encoded protein is a highly regulated enzyme that catalyzes the hydrolytic deamination of adenosine monophosphate to inosine monophosphate, a branch point in the adenylate catabolic pathway. This gene encodes the erythrocyte (E) isoforms, whereas other family members encode isoforms that predominate in muscle (M) and liver (L) cells. Mutations in this gene lead to the clinically asymptomatic, autosomal recessive condition erythrocyte AMP deaminase deficiency. Alternatively spliced transcript variants encoding different isoforms of this gene have been described. [provided by RefSeq, July 2008]. Transcript Variant: This variant (2) contains an alternate exon for its 5' UTR, lacks a portion of the 5' coding region, and initiates translation at a downstream start codon, compared to variant 1. It encodes isoform 1B, which has a shorter N-terminus, compared to isoform 1A. Publication Note: This RefSeq record includes a subset of the publications that are available for this gene. Please see the Gene record to access additional publications. |

TABLE 4-continued

| Gene name | Exon overlap | SEQ ID No | RefSeq Accession Number | mRNA Description | RefSeq Summary |
|---|---|---|---|---|---|
| AMPD3 | Y | 940 | NM_001025390 | *Homo sapiens* adenosine monophosphate deaminase 3 (AMPD3), transcript variant 3, mRNA. | This gene encodes a member of the AMP deaminase gene family. The encoded protein is a highly regulated enzyme that catalyzes the hydrolytic deamination of adenosine monophosphate to inosine monophosphate, a branch point in the adenylate catabolic pathway. This gene encodes the erythrocyte (E) isoforms, whereas other family members encode isoforms that predominate in muscle (M) and liver (L) cells. Mutations in this gene lead to the clinically asymptomatic, autosomal recessive condition erythrocyte AMP deaminase deficiency. Alternatively spliced transcript variants encoding different isoforms of this gene have been described. [provided by RefSeq, July 2008]. Transcript Variant: This variant (3) contains an alternate, in-frame exon for its 5' UTR and 5' coding region and initiates translation at an alternate start codon, compared to variant 1. It encodes isoform 1C, which has a shorter, distinct N-terminus, compared to isoform 1A. |
| AMPD3 | Y | 941 | NM_001172430 | *Homo sapiens* adenosine monophosphate deaminase 3 (AMPD3), transcript variant 4, mRNA. | This gene encodes a member of the AMP deaminase gene family. The encoded protein is a highly regulated enzyme that catalyzes the hydrolytic deamination of adenosine monophosphate to inosine monophosphate, a branch point in the adenylate catabolic pathway. This gene encodes the erythrocyte (E) isoforms, whereas other family members encode isoforms that predominate in muscle (M) and liver (L) cells. Mutations in this gene lead to the clinically asymptomatic, autosomal recessive condition erythrocyte AMP deaminase deficiency. Alternatively spliced transcript variants encoding different isoforms of this gene have been described. [provided by RefSeq, July 2008]. Transcript Variant: This variant (4) contains an alternate exon at a downstream start codon, compared to variant 1. It encodes isoform 1B, which has a shorter N-terminus, compared to isoform 1A. Sequence Note: This RefSeq record was created from transcript and genomic sequence data to make the sequence consistent with the reference genome assembly. The genomic coordinates used for the transcript record were based on transcript alignments. |
| AMPD3 | Y | 942 | NM_001172431 | *Homo sapiens* adenosine monophosphate deaminase 3 (AMPD3), transcript variant 5, mRNA. | This gene encodes a member of the AMP deaminase gene family. The encoded protein is a highly regulated enzyme that catalyzes the hydrolytic deamination of adenosine monophosphate to inosine monophosphate, a branch point in the adenylate catabolic pathway. This gene encodes the erythrocyte (E) isoforms, whereas other family members encode isoforms that predominate in muscle (M) and liver (L) cells. Mutations in this gene lead to the clinically asymptomatic, autosomal recessive condition erythrocyte AMP deaminase deficiency. Alternatively spliced transcript variants encoding different isoforms of this gene have been described. [provided by RefSeq, July 2008]. Transcript Variant: This variant (5) contains an alternate exon for its 5' UTR, lacks portions of the 5' coding region, and initiates translation at a downstream start codon, compared to variant 1. It encodes isoform 4, which has a shorter N-terminus, compared to isoform 1A. Sequence Note: This RefSeq record was created from transcript and genomic sequence data to make the sequence consistent with the reference genome assembly. The genomic coordinates used for the transcript record were based on transcript alignments. |
| LYVE1 | Y | 943 | NM_006691 | *Homo sapiens* lymphatic vessel endothelial hyaluronan receptor 1 (LYVE1), mRNA. | This gene encodes a type I integral membrane glycoprotein. The encoded protein acts as a receptor and binds to both soluble and immobilized hyaluronan. This protein may function in lymphatic hyaluronan transport and have a role in tumor metastasis. [provided by RefSeq, July 2008]. |
| MRVI1 | Y | 944 | NM_001098579 | *Homo sapiens* murine retrovirus integration site 1 homolog (MRVI1), transcript variant 1, mRNA. | This gene is similar to a putative mouse tumor suppressor gene (Mrvi1) that is frequently disrupted by mouse AIDS-related virus (MRV). The encoded protein, which is found in the membrane of the endoplasmic reticulum, is similar to Jaw1, a lymphoid-restricted protein whose expression is down-regulated during lymphoid differentiation. This protein is a substrate of cGMP-dependent kinase-1 (PKG1) that can function as a regulator of IP3-induced calcium release. Studies in mouse suggest that MRV integration at Mrvi1 induces myeloid leukemia by altering the expression of a gene important for myeloid cell growth and/or differentiation, and thus this gene may function as a myeloid leukemia tumor suppressor gene. Several alternatively spliced transcript variants encoding different isoforms have been found for this gene, and alternative translation start sites, including a non-AUG (CUG) start |

TABLE 4-continued

| Gene name | Exon overlap | SEQ ID No | RefSeq Accession Number | mRNA Description | RefSeq Summary |
|---|---|---|---|---|---|
| MRVI1 | Y | 945 | NM_001100163 | Homo sapiens murine retrovirus integration site 1 homolog (MRVI1), transcript variant 3, mRNA. | site, are used. [provided by RefSeq, May 2011]. Transcript Variant: This variant (1) encodes isoform a, also known as MRV1A. Sequence Note: This RefSeq record was created from transcript and genomic sequence data to make the sequence consistent with the reference genome assembly. The genomic coordinates used for the transcript record were based on transcript alignments. This gene is similar to a putative mouse tumor suppressor gene (Mrvi1) that is frequently disrupted by mouse AIDS-related virus (MRV). The encoded protein, which is found in the membrane of the endoplasmic reticulum, is similar to Jaw1, a lymphoid-restricted protein whose expression is down-regulated during lymphoid differentiation. This protein is a substrate of cGMP-dependent kinase-1 (PKG1) that can function as a regulator of IP3-induced calcium release. Studies in mouse suggest that MRV integration at Mrvi1 induces myeloid leukemia by altering the expression of a gene important for myeloid cell growth and/or differentiation, and thus this gene may function as a myeloid leukemia tumor suppressor gene. Several alternatively spliced transcript variants encoding different isoforms have been found for this gene, and alternative translation start sites, including a non-AUG (CUG) start site, are used. [provided by RefSeq, May 2011]. Transcript Variant: This variant (3) differs in the 5' UTR, lacks a portion of the 5' coding region, initiates translation from an downstream in-frame non-AUG (CUG) start codon, and uses an alternate in-frame splice site in the central coding region, compared to variant 1. The encoded isoform (b, also known as MRV1B) is shorter at the N-terminus, compared to isoform a. Sequence Note: This RefSeq record was created from transcript and genomic sequence data to make the sequence consistent with the reference genome assembly. The genomic coordinates used for the transcript record were based on transcript alignments. |
| MRVI1 | Y | 946 | NM_001100167 | Homo sapiens murine retrovirus integration site 1 homolog (MRVI1), transcript variant 4, mRNA. | This gene is similar to a putative mouse tumor suppressor gene (Mrvi1) that is frequently disrupted by mouse AIDS-related virus (MRV). The encoded protein, which is found in the membrane of the endoplasmic reticulum, is similar to Jaw1, a lymphoid-restricted protein whose expression is down-regulated during lymphoid differentiation. This protein is a substrate of cGMP-dependent kinase-1 (PKG1) that can function as a regulator of IP3-induced calcium release. Studies in mouse suggest that MRV integration at Mrvi1 induces myeloid leukemia by altering the expression of a gene important for myeloid cell growth and/or differentiation, and thus this gene may function as a myeloid leukemia tumor suppressor gene. Several alternatively spliced transcript variants encoding different isoforms have been found for this gene, and alternative translation start sites, including a non-AUG (CUG) start site, are used. [provided by RefSeq, May 2011]. Transcript Variant: This variant (4) differs in the 5' UTR, lacks a portion of the 5' coding region, and uses a downstream in-frame start codon, compared to variant 1. The encoded isoform (c) is shorter at the N-terminus, compared to isoform a. Both variants 4 and 6 encode the same isoform. Sequence Note: This RefSeq record was created from transcript and genomic sequence coordinates used for the transcript record were based on transcript alignments. CCDS Note: This CCDS representation uses a downstream AUG start codon compared to CCDS44539.1. It is supported by the mRNA AK127209.1, which lacks the exon containing the alternative non-AUG (CUG) start codon described in PMID:10321731. Publication Note: This RefSeq record includes a subset of the publications that are available for this gene. Please see the Gene record to access additional publications. |
| MRVI1 | Y | 947 | NM_001206880 | Homo sapiens murine retrovirus integration site 1 homolog (MRVI1), transcript variant 5, mRNA. | This gene is similar to a putative mouse tumor suppressor gene (Mrvi1) that is frequently disrupted by mouse AIDS-related virus (MRV). The encoded protein, which is found in the membrane of the endoplasmic reticulum, is similar to Jaw1, a lymphoid-restricted protein whose expression is down-regulated during lymphoid differentiation. This protein is a substrate of cGMP-dependent kinase-1 (PKG1) that can function as a regulator of IP3-induced calcium release. Studies in mouse suggest that MRV integration at Mrvi1 induces myeloid leukemia by altering the expression of a gene important for myeloid cell growth and/or differentiation, and thus this gene may function as a myeloid leukemia tumor suppressor gene. Several alternatively spliced transcript variants encoding different isoforms have been found for this gene, and alternative translation start sites, including a non-AUG (CUG) start |

TABLE 4-continued

| Gene name | Exon overlap | SEQ ID No | RefSeq Accession Number | mRNA Description | RefSeq Summary |
|---|---|---|---|---|---|
| | | | | | site, are used. [provided by RefSeq, May 2011]. Transcript Variant: This variant (5) differs in the 5' UTR and 5' coding region, and uses an alternate in-frame splice site and lacks an alternate in-frame exon in the central coding region, compared to variant 1. The encoded isoform (e) has a distinct N-terminus and is shorter than isoform a. Sequence Note: This RefSeq record was created from transcript and genomic sequence data to make the sequence consistent with the reference genome assembly. The genomic coordinates used for the transcript record were based on transcript alignments. |
| MRVI1 | Y | 948 | NM_001206881 | Homo sapiens murine retrovirus integration site 1 homolog (MRVI1), transcript variant 6, mRNA. | This gene is similar to a putative mouse tumor suppressor gene (Mrvi1) that is frequently disrupted by mouse AIDS-related virus (MRV). The encoded protein, which is found in the membrane of the endoplasmic reticulum, is similar to Jaw1, a lymphoid-restricted protein whose expression is down-regulated during lymphoid differentiation. This protein is a substrate of cGMP-dependent kinase-1 (PKG1) that can function as a regulator of IP3-induced calcium release. Studies in mouse suggest that MRV integration at Mrvi1 induces myeloid leukemia by altering the expression of a gene important for myeloid cell growth and/or differentiation, and thus this gene may function as a myeloid leukemia tumor suppressor gene. Several alternatively spliced transcript variants encoding different isoforms have been found for this gene, and alternative translation start sites, including a non-AUG (CUG) start site, are used. [provided by RefSeq, May 2011]. Transcript Variant: This variant (6) differs in the 5' UTR, lacks a portion of the 5' coding region, and uses a downstream in-frame start codon, compared to variant 1. The encoded isoform (c) is shorter at the N-terminus, compared to isoform a. Both variants 4 and 6 encode the same isoform. Sequence Note: This RefSeq record was created from transcript and genomic sequence data to make the sequence consistent with the reference genome assembly. The genomic coordinates used for the transcript record were based on transcript alignments. CCDS Note: This CCDS representation uses a downstream AUG start codon compared to CCDS44539.1. It is supported by the mRNA AK127209.1, which lacks the exon containing the alternative non-AUG (CUG) start codon described in PMID:10321731. Publication Note: This RefSeq record includes a subset of the publications that are available for this gene. Please see the Gene record to access additional publications. |
| MRVI1 | Y | 949 | NM_130385 | Homo sapiens murine retrovirus integration site 1 homolog (MRVI1), transcript variant 2, mRNA. | This gene is similar to a putative mouse tumor suppressor gene (Mrvi1) that is frequently disrupted by mouse AIDS-related virus (MRV). The encoded protein, which is found in the membrane of the endoplasmic reticulum, is similar to Jaw1, a lymphoid-restricted protein whose expression is down-regulated during lymphoid differentiation. This protein is a substrate of cGMP-dependent kinase-1 (PKG1) that can function as a regulator of IP3-induced calcium release. Studies in mouse suggest that MRV integration at Mrvi1 induces myeloid leukemia by altering the expression of a gene important for myeloid cell growth and/or differentiation, and thus this gene may function as a myeloid leukemia tumor suppressor gene. Several alternatively spliced transcript variants encoding different isoforms have been found for this gene, and alternative translation start sites, including a non-AUG (CUG) start site, are used. [provided by RefSeq, May 2011]. Transcript Variant: This variant (2) differs in the 5' UTR and 5' coding region, and uses an alternate in-frame splice site in the central coding region, compared to variant 1. The encoded isoform (d) has a distinct N-terminus and is longer than isoform a. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| MTRNR2L8 | Y | 950 | NM_001190702 | Homo sapiens MT-RNR2-like 8 (MTRNR2L8), mRNA. | N/A |
| RNF141 | Y | 951 | NM_016422 | Homo sapiens ring finger protein 141 (RNF141), mRNA. | The protein encoded by this gene contains a RING finger, a motif known to be involved in protein-DNA and protein-protein interactions. Abundant expression of this gene was found in the testicular tissue of fertile men, but was not detected in azoospermic patients. Studies of the mouse counterpart |

TABLE 4-continued

| Gene name | Exon overlap | SEQ ID No | RefSeq Accession Number | mRNA Description | RefSeq Summary |
|---|---|---|---|---|---|
| SBF2 | Y | 952 | NM_030962 | Homo sapiens SET binding factor 2 (SBF2), mRNA. | suggest that this gene may function as a testis specific transcription factor during spermatogenesis. [provided by RefSeq, July 2008].<br>This gene encodes a pseudophosphatase and member of the myotubularin-related protein family. This gene maps within the CMT4B2 candidate region of chromosome 11p15 and mutations in this gene have been associated with Charcot-Marie-Tooth Disease, type 4B2. [provided by RefSeq, July 2008]. Publication Note: This RefSeq record includes a subset of the publications that are available for this gene. Please see the Gene record to access additional publications. |
| C16orf90 | Y | 953 | NM_001080524 | Homo sapiens chromosome 16 open reading frame 90 (C16orf90), mRNA. | N/A |
| CLUAP1 | Y | 954 | NM_015041 | Homo sapiens clusterin associated protein 1 (CLUAP1), transcript variant 1, mRNA. | N/A |
| CLUAP1 | Y | 955 | NM_024793 | Homo sapiens clusterin associated protein 1 (CLUAP1), transcript variant 2, mRNA. | N/A |
| MTRNR2L4 | Y | 956 | NM_001190476 | Homo sapiens MT-RNR2-like 4 (MTRNR2L4), mRNA. | N/A |
| NLRC3 | Y | 957 | NM_178844 | Homo sapiens NLR family, CARD domain containing 3 (NLRC3), mRNA. | N/A |
| SLX4 | Y | 958 | NM_032444 | Homo sapiens SLX4 structure-specific endonuclease subunit homolog (S. cerevisiae) (SLX4), mRNA. | This gene encodes a structure-specific endonuclease subunit. The encoded protein contains a central BTB domain and it forms a multiprotein complex with the ERCC4(XPF)-ERCC1, MUS81-EME1, and SLX1 endonucleases, and also associates with MSH2/MSH3 mismatch repair complex, telomere binding complex TERF2(TRF2)-TERF2IP(RAP1), the protein kinase PLK1 and the uncharacterized protein C20orf94. The multiprotein complex is required for repair of specific types of DNA lesions and is critical for cellular responses to replication fork failure. The encoded protein acts as a docking platform for the assembly of multiple structure-specific endonucleases. [provided by RefSeq, January 2011]. |
| ZNF174 | Y | 959 | NM_001032292 | Homo sapiens zinc finger protein 174 (ZNF174), transcript variant 2, mRNA. | N/A |
| ZNF174 | Y | 960 | NM_003450 | Homo sapiens zinc finger protein 174 (ZNF174), transcript variant 1, mRNA. | N/A |
| ZNF434 | Y | 961 | NM_017810 | Homo sapiens zinc finger protein 434 (ZNF434), mRNA. | N/A |
| ZNF597 | Y | 962 | NM_152457 | Homo sapiens zinc finger protein 597 (ZNF597), mRNA. | N/A |
| CNBD1 | N | 963 | NM_173538 | Homo sapiens cyclic nucleotide binding domain containing 1 (CNBD1), mRNA. | N/A |
| DPP6 | N | 964 | NM_001039350 | Homo sapiens dipeptidyl-peptidase 6 (DPP6), | This gene encodes a single-pass type II membrane protein that is a member of the S9B family in clan SC of the serine proteases. This protein has no detectable protease activity, most likely due to the |

TABLE 4-continued

| Gene name | Exon overlap | SEQ ID No | RefSeq Accession Number | mRNA Description | RefSeq Summary |
|---|---|---|---|---|---|
| | | | | transcript variant 3, mRNA. | absence of the conserved serine residue normally present in the catalytic domain of serine proteases. However, it does bind specific voltage-gated potassium channels and alters their expression and biophysical properties. Alternate transcriptional splice variants, encoding different isoforms, have been characterized. [provided by RefSeq, July 2008]. Transcript Variant: This variant (3) includes an alternate in-frame exon, compared to variant 1, resulting in a shorter protein (isoform 3) that has a shorter and distinct N-terminus, compared to isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| DPP6 | N | 965 | NM_001936 | *Homo sapiens* dipeptidyl-peptidase 6 (DPP6), transcript variant 2, mRNA. | This gene encodes a single-pass type II membrane protein that is a member of the S9B family in clan SC of the serine proteases. This protein has no detectable protease activity, most likely due to the absence of the conserved serine residue normally present in the catalytic domain of serine proteases. However, it does bind specific voltage-gated potassium channels and alters their expression and biophysical properties. Alternate transcriptional splice variants, encoding different isoforms, have been characterized. [provided by RefSeq, July 2008]. Transcript Variant: This variant (2) includes an alternate in-frame exon, compared to variant 1, resulting in a shorter protein (isoform 2, also referred to as S) that has a shorter and distinct N-terminus, compared to isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| DPP6 | N | 966 | NM_130797 | *Homo sapiens* dipeptidyl-peptidase 6 (DPP6), transcript variant 1, mRNA. | This gene encodes a single-pass type II membrane protein that is a member of the S9B family in clan SC of the serine proteases. This protein has no detectable protease activity, most likely due to the absence of the conserved serine residue normally present in the catalytic domain of serine proteases. However, it does bind specific voltage-gated potassium channels and alters their expression and biophysical properties. Alternate transcriptional splice variants, encoding different isoforms, have been characterized. [provided by RefSeq, July 2008]. Transcript Variant: This variant (1) encodes the longest isoform (1, also referred to as L). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| CNTNAP2 | N | 967 | NM_014141 | *Homo sapiens* contactin associated protein-like 2 (CNTNAP2), mRNA. | This gene encodes a member of the neurexin family which functions in the vertebrate nervous system as cell adhesion molecules and receptors. This protein, like other neurexin proteins, contains epidermal growth factor repeats and laminin G domains. In addition, it includes an F5/8 type C domain, discoidin/neuropilin- and fibrinogen-like domains, thrombospondin N-terminal-like domains and a putative PDZ binding site. This protein is localized at the juxtaparanodes of myelinated axons, and mediates interactions between neurons and glia during nervous system development and is also involved in localization of potassium channels within differentiating axons. This gene encompasses almost 1.5% of chromosome 7 and is one of the largest genes in the human genome. It is directly bound and regulated by forkhead box protein P2 (FOXP2), a transcription factor related to speech and language development. This gene has been implicated in multiple neurodevelopmental disorders, including Gilles de la Tourette syndrome, schizophrenia, epilepsy, autism, ADHD and mental retardation. [provided by RefSeq, March 2010]. Sequence Note: This RefSeq record was created from transcript and genomic sequence data to make the sequence consistent with the reference genome assembly. The genomic coordinates used for the transcript record were based on transcript alignments. |
| DOCK5 | N | 968 | NM_024940 | *Homo sapiens* dedicator of cytokinesis 5 (DOCK5), | N/A |

TABLE 4-continued

| Gene name | Exon overlap | SEQ ID No | RefSeq Accession Number | mRNA Description | RefSeq Summary |
|---|---|---|---|---|---|
| BTNL8 | Y | 969 | NM_001040462 | Homo sapiens butyrophilin-like 8 (BTNL8), transcript variant 2, mRNA. | N/A |
| BTNL8 | Y | 970 | NM_001159707 | Homo sapiens butyrophilin-like 8 (BTNL8), transcript variant 3, mRNA. | N/A |
| BTNL8 | Y | 971 | NM_001159708 | Homo sapiens butyrophilin-like 8 (BTNL8), transcript variant 4, mRNA. | N/A |
| BTNL8 | Y | 972 | NM_001159709 | Homo sapiens butyrophilin-like 8 (BTNL8), transcript variant 5, mRNA. | N/A |
| BTNL8 | Y | 973 | NM_001159710 | Homo sapiens butyrophilin-like 8 (BTNL8), transcript variant 6, mRNA. | N/A |
| BTNL8 | Y | 974 | NM_024850 | Homo sapiens butyrophilin-like 8 (BTNL8), transcript variant 1, mRNA. | N/A |
| LOC729678 | Y | 975 | NR_027183 | Homo sapiens uncharacterized LOC729678 (LOC729678), non-coding RNA. | N/A |
| ZFP62 | Y | 976 | NM_001172638 | Homo sapiens zinc finger protein 62 homolog (mouse) (ZFP62), transcript variant 2, mRNA. | N/A |
| ZFP62 | Y | 977 | NM_152283 | Homo sapiens zinc finger protein 62 homolog (mouse) (ZFP62), transcript variant 1, mRNA. | N/A |
| APOBEC3A | Y | 978 | NM_001193289 | Homo sapiens apolipoprotein B mRNA editing enzyme, catalytic polypeptide-like 3A (APOBEC3A), transcript variant 2, mRNA. | This gene is a member of the cytidine deaminase gene family. It is one of seven related genes or pseudogenes found in a cluster, thought to result from gene duplication, on chromosome 22. Members of the cluster encode proteins that are structurally and functionally related to the C to U RNA-editing cytidine deaminase APOBEC1. The protein encoded by this gene lacks the zinc binding activity of other family members. The protein plays a role in immunity, by restricting transmission of foreign DNA such as viruses. One mechanism of foreign DNA restriction is deamination of foreign double-stranded DNA cytidines to uridines, which leads to DNA degradation. However, other mechanisms are also thought to be involved, as anti-viral effect is not dependent on deaminase activity. One allele of this gene results from the deletion of approximately 29.5 kb of sequence between this gene, APOBEC3A, and the adjacent gene APOBEC3B. The breakpoints of the deletion are within the two genes, so the deletion allele is predicted to have the promoter and coding region of APOBEC3A, but the 3' UTR of APOBEC3B. [provided by RefSeq, July 2010]. Transcript Variant: This variant (2) represents the deletion allele; its 5' UTR and coding region are derived from APOBEC3A, while its 3'UTR is derived from APOBEC3B. Variants 1 and 2 encode the same protein. |
| APOBEC3A | Y | 979 | NM_145699 | Homo sapiens apolipoprotein B mRNA editing enzyme, catalytic polypeptide-like 3A | This gene is a member of the cytidine deaminase gene family. It is one of seven related genes or pseudogenes found in a cluster, thought to result from gene duplication, on chromosome 22. Members of the cluster encode proteins that are structurally and functionally related to the C to U RNA-editing cytidine deaminase APOBEC1. The protein encoded by this gene lacks the zinc binding activity of |

TABLE 4-continued

| Gene name | Exon overlap | SEQ ID No | RefSeq Accession Number | mRNA Description | RefSeq Summary |
|---|---|---|---|---|---|
| | | | | (APOBEC3A), transcript variant 1, mRNA. | other family members. The protein plays a role in immunity, by restricting transmission of foreign DNA such as viruses. One mechanism of foreign DNA restriction is deamination of foreign double-stranded DNA cytidines to uridines, which leads to DNA degradation. However, other mechanisms are also thought to be involved, as anti-viral effect is not dependent on deaminase activity. One allele of this gene results from the deletion of approximately 29.5 kb of sequence between this gene, APOBEC3A, and the adjacent gene APOBEC3B. The breakpoints of the deletion are within the two genes, so the deletion allele is predicted to have the promoter and coding region of APOBEC3A, but the 3' UTR of APOBEC3B. [provided by RefSeq, July 2010]. Transcript Variant: This variant (1) represents the longer transcript. Variants 1 and 2 encode the same protein. |
| TMPRSS11E | Y | 980 | NM_014058 | Homo sapiens transmembrane protease, serine 11E (TMPRSS11E), mRNA. | N/A |
| UGT2B15 | Y | 981 | NM_001076 | Homo sapiens UDP glucuronosyltransferase 2 family, polypeptide B15 (UGT2B15), mRNA. | This gene encodes a member of the UDP-glycosyltransferase (UDPGT) family. The UDPGTs are of major importance in the conjugation and subsequent elimination of potentially toxic xenobiotics and endogenous compounds. This protein displays activity towards several classes of xenobiotic substrates, including simple phenolic compounds, 7-hydroxylated coumarins, flavonoids, anthraquinones, and certain drugs and their hydroxylated metabolites. It also catalyzes the glucuronidation of endogenous estrogens and androgens. [provided by RefSeq, October 2011]. |
| PRSS1 | Y | 982 | NM_002769 | Homo sapiens protease, serine, 1 (trypsin 1) (PRSS1), mRNA. | This gene encodes a trypsinogen, which is a member of the trypsin family of serine proteases. This enzyme is secreted by the pancreas and cleaved to its active form in the small intestine. It is active on peptide linkages involving the carboxyl group of lysine or arginine. Mutations in this gene are associated with hereditary pancreatitis. This gene and several other trypsinogen genes are localized to the T cell receptor beta locus on chromosome 7. [provided by RefSeq, July 2008]. |
| PRSS2 | Y | 983 | NM_002770 | Homo sapiens protease, serine, 2 (trypsin 2) (PRSS2), mRNA. | This gene encodes a trypsinogen, which is a member of the trypsin family of serine proteases. This enzyme is secreted by the pancreas and cleaved to its active form in the small intestine. It is active on peptide linkages involving the carboxyl group of lysine or arginine. This gene and several other trypsinogen genes are localized to the T cell receptor beta locus on chromosome 7. [provided by RefSeq, July 2008]. |
| NDST3 | N | 984 | NM_004784 | Homo sapiens N-deacetylase/N-sulfotransferase (heparan glucosaminyl) 3 (NDST3), mRNA. | This gene encodes a member of the heparan sulfate/heparin GlcNAc N-deacetylase/N-sulfotransferase family. The encoded enzyme is a type II transmembrane protein that resides in the Golgi apparatus. This monomeric bifunctional enzyme catalyzes the N-deacetylation and N-sulfation of N-acetylglucosamine residues in heparan sulfate and heparin, which are the initial chemical modifications required for the biosynthesis of the functional oligosaccharide sequences that define the specific ligand binding activities of heparan sulfate and heparin. [provided by RefSeq, November 2008]. |
| HEATR4 | N | 985 | NM_001220484 | Homo sapiens HEAT repeat containing 4 (HEATR4), transcript variant 1, mRNA. | N/A |
| HEATR4 | N | 986 | NM_203309 | Homo sapiens HEAT repeat containing 4 (HEATR4), transcript variant 2, mRNA. | N/A |
| KIAA1267 | N | 987 | NM_001193465 | Homo sapiens KIAA1267 (KIAA1267), transcript variant 3, mRNA. | N/A |
| KIAA1267 | N | 988 | NM_001193466 | Homo sapiens KIAA1267 (KIAA1267), transcript variant 1, mRNA. | N/A |

TABLE 4-continued

| Gene name | Exon overlap | SEQ ID No | RefSeq Accession Number | mRNA Description | RefSeq Summary |
|---|---|---|---|---|---|
| KIAA1267 | N | 989 | NM_015443 | Homo sapiens KIAA1267 (KIAA1267), transcript variant 2, mRNA. | N/A |
| NSF | N | 990 | NM_006178 | Homo sapiens N-ethylmaleimide-sensitive factor (NSF), transcript variant 1, mRNA. | N/A |
| NSF | N | 991 | NM_040116 | Homo sapiens N-ethylmaleimide-sensitive factor (NSF), transcript variant 2, non-coding RNA. | N/A |
| C6orf127 | Y | 992 | NM_001010886 | Homo sapiens chromosome 6 open reading frame 127 (C6orf127), mRNA. | N/A |
| LCP1 | N | 993 | NM_002298 | Homo sapiens lymphocyte cytosolic protein 1 (L-plastin) (LCP1), mRNA. | Plastins are a family of actin-binding proteins that are conserved throughout eukaryote evolution and expressed in most tissues of higher eukaryotes. In humans, two ubiquitous plastin isoforms (L and T) have been identified. Plastin 1 (otherwise known as Fimbrin) is a third distinct plastin isoform which is specifically expressed at high levels in the small intestine. The L isoform is expressed only in hemopoietic cell lineages, while the T isoform has been found in all other normal cells of solid tissues that have replicative potential (fibroblasts, endothelial cells, epithelial cells, melanocytes, etc.). However, L-plastin has been found in many types of malignant human cells of non-hemopoietic origin suggesting that its expression is induced accompanying tumorigenesis in solid tissues. [provided by RefSeq, July 2008]. Publication Note: This RefSeq record includes a subset of the publications that are available for this gene. Please see the Gene record to access additional publications. |
| TXLNB | N | 994 | NM_153235 | Homo sapiens taxilin beta (TXLNB), mRNA. | N/A |
| OR52N1 | Y | 995 | NM_001001913 | Homo sapiens olfactory receptor, family 52, subfamily N, member 1 (OR52N1), mRNA. | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, July 2008]. |
| C10orf11 | N | 996 | NM_032024 | Homo sapiens chromosome 10 open reading frame 11 (C10orf11), mRNA. | N/A |
| C9orf169 | Y | 997 | NM_199001 | Homo sapiens chromosome 9 open reading frame 169 (C9orf169), mRNA. | N/A |
| RNF208 | Y | 998 | NM_031297 | Homo sapiens ring finger protein 208 (RNF208), mRNA. | N/A |
| DPP10 | N | 999 | NM_001004360 | Homo sapiens dipeptidyl-peptidase 10 (non-functional) (DPP10), transcript variant 2, mRNA. | This gene encodes a single-pass type II membrane protein that is a member of the S9B family in clan SC of the serine proteases. This protein has no detectable protease activity, most likely due to the absence of the conserved serine residue normally present in the catalytic domain of serine proteases. However, it does bind specific voltage-gated potassium channels and alters their expression and biophysical properties. Mutations in this gene have been associated with asthma. Alternate transcriptional splice variants, encoding different isoforms, have been characterized. [provided by RefSeq, July 2008]. Transcript Variant: This variant (2) has an alternate 5' exon, as compared to variant |

TABLE 4-continued

| Gene name | Exon overlap | SEQ ID No | RefSeq Accession Number | mRNA Description | RefSeq Summary |
|---|---|---|---|---|---|
| | | | | | 3. The resulting isoform (short, also referred to as DPL2-s and d) has a shorter and distinct N-terminus when compared to isoform c. Sequence Note: This RefSeq record was created from transcript and genomic sequence data to make the sequence consistent with the reference genome assembly. The genomic coordinates used for the transcript record were based on transcript alignments. Sequence Note: removed 2 bases from the 5' end that did not align to the reference genome assembly. Publication Note: This RefSeq record includes a subset of the publications that are available for this gene. Please see the Gene record to access additional publications. |
| DPP10 | N | 1000 | NM_001178034 | Homo sapiens dipeptidyl-peptidase 10 (non-functional) (DPP10), transcript variant 3, mRNA. | This gene encodes a single-pass type II membrane protein that is a member of the S9B family in clan SC of the serine proteases. This protein has no detectable protease activity, most likely due to the absence of the conserved serine residue normally present in the catalytic domain of serine proteases. However, it does bind specific voltage-gated potassium channels and alters their expression and biophysical properties. Mutations in this gene have been associated with asthma. Alternate transcriptional splice variants, encoding different isoforms, have been characterized. [provided by RefSeq, July 2008]. Transcript Variant: This variant (1) encodes the longest isoform (c). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| DPP10 | N | 1001 | NM_001178036 | Homo sapiens dipeptidyl-peptidase 10 (non-functional) (DPP10), transcript variant 5, mRNA. | This gene encodes a single-pass type II membrane protein that is a member of the S9B family in clan SC of the serine proteases. This protein has no detectable protease activity, most likely due to the absence of the conserved serine residue normally present in the catalytic domain of serine proteases. However, it does bind specific voltage-gated potassium channels and alters their expression and biophysical properties. Mutations in this gene have been associated with asthma. Alternate transcriptional splice variants, encoding different isoforms, have been characterized. [provided by RefSeq, July 2008]. Transcript Variant: This variant (5) has an alternate 5' exon, as compared to variant 3. The resulting isoform (a) has a shorter and distinct N-terminus when compared to isoform c. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| DPP10 | N | 1002 | NM_001178037 | Homo sapiens dipeptidyl-peptidase 10 (non-functional) (DPP10), transcript variant 4, mRNA. | This gene encodes a single-pass type II membrane protein that is a member of the S9B family in clan SC of the serine proteases. This protein has no detectable protease activity, most likely due to the absence of the conserved serine residue normally present in the catalytic domain of serine proteases. However, it does bind specific voltage-gated potassium channels and alters their expression and biophysical properties. Mutations in this gene have been associated with asthma. Alternate transcriptional splice variants, encoding different isoforms, have been characterized. [provided by RefSeq, July 2008]. Transcript Variant: This variant (4) has an alternate 5' exon, as compared to variant 3. The resulting isoform (b) has a shorter and distinct N-terminus when compared to isoform c. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| DPP10 | N | 1003 | NM_020868 | Homo sapiens dipeptidyl-peptidase 10 (non-functional) (DPP10), transcript variant 1, mRNA. | This gene encodes a single-pass type II membrane protein that is a member of the S9B family in clan SC of the serine proteases. This protein has no detectable protease activity, most likely due to the absence of the conserved serine residue normally present in the catalytic domain of serine proteases. However, it does bind specific voltage-gated potassium channels and alters their expression and |

TABLE 4-continued

| Gene name | Exon overlap | SEQ ID No | RefSeq Accession Number | mRNA Description | RefSeq Summary |
|---|---|---|---|---|---|
| | | | | | biophysical properties. Mutations in this gene have been associated with asthma. Alternate transcriptional splice variants, encoding different isoforms, have been characterized. [provided by RefSeq, July 2008]. Transcript Variant: This variant (1) has an alternate 5' exon, as compared to variant 3. The resulting isoform (long, also referred to as DPL2-1) is slightly shorter and has a distinct N-terminus when compared to isoform c. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| CFH | Y | 1004 | NM_000186 | Homo sapiens complement factor H (CFH), nuclear gene encoding mitochondrial protein, transcript variant 1, mRNA. | This gene is a member of the Regulator of Complement Activation (RCA) gene cluster and encodes a protein with twenty short consensus repeat (SCR) domains. This protein is secreted into the bloodstream and has an essential role in the regulation of complement activation, restricting this innate defense mechanism to microbial infections. Mutations in this gene have been associated with hemolytic-uremic syndrome (HUS) and chronic hypocomplementemic nephropathy. Alternate transcriptional splice variants, encoding different isoforms, have been characterized. [provided by RefSeq, October 2011]. Transcript Variant: This variant (1) represents the longer transcript and encodes the longer isoform (a). |
| CFH | Y | 1005 | NM_001014975 | Homo sapiens complement factor H (CFH), nuclear gene encoding mitochondrial protein, transcript variant 2, mRNA. | This gene is a member of the Regulator of Complement Activation (RCA) gene cluster and encodes a protein with twenty short consensus repeat (SCR) domains. This protein is secreted into the bloodstream and has an essential role in the regulation of complement activation, restricting this innate defense mechanism to microbial infections. Mutations in this gene have been associated with hemolytic-uremic syndrome (HUS) and chronic hypocomplementemic nephropathy. Alternate transcriptional splice variants, encoding different isoforms, have been characterized. [provided by RefSeq, October 2011]. Transcript Variant: This variant (2) utilizes an alternate terminal exon which results in an early stop codon. The resulting protein (isoform b, also known as the 'factor H-like 1' or 'FHL-1' isoform) has a distinct C-terminus and is shorter than isoform a. |
| PHF17 | N | 1006 | NM_024900 | Homo sapiens PHD finger protein 17 (PHF17), transcript variant S, mRNA. | N/A |
| PHF17 | N | 1007 | NM_199320 | Homo sapiens PHD finger protein 17 (PHF17), transcript variant L, mRNA. | N/A |
| LAMC2 | N | 1008 | NM_005562 | Homo sapiens laminin, gamma 2 (LAMC2), transcript variant 1, mRNA. | Laminins, a family of extracellular matrix glycoproteins, are the major noncollagenous constituent of basement membranes. They have been implicated in a wide variety of biological processes including cell adhesion, differentiation, migration, signaling, neurite outgrowth and metastasis. Laminins, composed of 3 non identical chains: laminin alpha, beta and gamma (formerly A, B1, and B2, respectively), have a cruciform structure consisting of 3 short arms, each formed by a different chain, and a long arm composed of all 3 chains. Each laminin chain is a multidomain protein encoded by a distinct gene. Several isoforms of each chain have been described. Different alpha, beta and gamma chain isomers combine to give rise to different heterotrimeric laminin isoforms which are designated by Arabic numerals in the order of their discovery, i.e. alpha1beta1gamma1 heterotrimer is laminin 1. The biological functions of the different chains and trimer molecules are largely unknown, but some of the chains have been shown to differ with respect to their tissue distribution, presumably reflecting diverse functions in vivo. This gene encodes the gamma chain isoform laminin, gamma 2. The gamma 2 chain, formerly thought to be a truncated version of beta chain (B2t), is highly homologous to the gamma 1 chain; however, it lacks domain VI, and domains V, IV and III are shorter. It is expressed in several fetal tissues but differently from gamma 1, and is specifically localized to epithelial cells in skin, lung and kidney. The gamma 2 chain together with alpha 3 and beta 3 chains constitute laminin 5 (earlier known as kalinin), which is an integral part of the anchoring filaments that connect epithelial |

TABLE 4-continued

| Gene name | Exon overlap | SEQ ID No | RefSeq Accession Number | mRNA Description | RefSeq Summary |
|---|---|---|---|---|---|
| | | | | | cells to the underlying basement membrane. The epithelium-specific expression of the gamma 2 chain implied its role as an epithelium attachment molecule, and mutations in this gene have been associated with junctional epidermolysis bullosa, a skin disease characterized by blisters due to disruption of the epidermal-dermal junction. Two transcript variants resulting from alternative splicing of the 3' terminal exon, and encoding different isoforms of gamma 2 chain, have been described. The two variants are differentially expressed in embryonic tissues, however, the biological significance of the two forms is not known. Transcript variants utilizing alternative polyA_signal have also been noted in literature. [provided by RefSeq, August 2011]. Transcript Variant: This variant (1) represents the full length transcript variant. It encodes isoform (a) which is expressed in the epithelia of embryonic tissues. Sequence Note: This RefSeq record was created from transcript and genomic sequence data because transcript sequence consistent with the reference genome assembly was not available for all regions of the RefSeq transcript. The extent of this transcript is supported by transcript alignments. |
| LAMC2 | N | 1009 | NM_018891 | Homo sapiens laminin, gamma 2 (LAMC2), transcript variant 2, mRNA. | Laminins, a family of extracellular matrix glycoproteins, are the major noncollagenous constituent of basement membranes. They have been implicated in a wide variety of biological processes including cell adhesion, differentiation, migration, signaling, neurite outgrowth and metastasis. Laminins, composed of 3 non identical chains: laminin alpha, beta and gamma (formerly A, B1, and B2, respectively), have a cruciform structure consisting of 3 short arms, each formed by a different chain, and a long arm composed of all 3 chains. Each laminin chain is a multidomain protein encoded by a distinct gene. Several isoforms of each chain have been described. Different alpha, beta and gamma chain isomers combine to give rise to different heterotrimeric laminin isoforms which are designated by Arabic numerals in the order of their discovery, i.e. alpha1beta1gamma1 heterotrimer is laminin 1. The biological functions of the different chains and trimer molecules are largely unknown, but some of the chains have been shown to differ with respect to their tissue distribution, presumably reflecting diverse functions in vivo. This gene encodes the gamma chain isoform laminin, gamma 2. The gamma 2 chain, formerly thought to be a truncated version of beta chain (B2t), is highly homologous to the gamma 1 chain; however, it lacks domain VI, and domains V, IV and III are shorter. It is expressed in several fetal tissues but differently from gamma 1, and is specifically localized to epithelial cells in skin, lung and kidney. The gamma 2 chain together with alpha 3 and beta 3 chains constitute laminin 5 (earlier known as kalinin), which is an integral part of the anchoring filaments that connect epithelial cells to the underlying basement membrane. The epithelium-specific expression of the gamma 2 chain implied its role as an epithelium attachment molecule, and mutations in this gene have been associated with junctional epidermolysis bullosa, a skin disease characterized by blisters due to disruption of the epidermal-dermal junction. Two transcript variants resulting from alternative splicing of the 3' terminal exon, and encoding different isoforms of gamma 2 chain, have been described. The two variants are differentially expressed in embryonic tissues, however, the biological significance of the two forms is not known. Transcript variants utilizing alternative polyA_signal have also been noted in literature. [provided by RefSeq, August 2011]. Transcript Variant: This variant (2) represents a shorter transcript variant, compared to variant 1, and encodes a shorter isoform (b). Transcript variant 2, unlike variant 1, has limited expression only in the embryonic cerebral cortex, lung and distal tubules of the kidney. Sequence Note: This RefSeq record was created from transcript and genomic sequence data because transcript sequence consistent with the reference genome assembly was not available for all regions of the RefSeq transcript. The extent of this transcript is supported by transcript alignments. |
| C7orf50 | N | 1010 | NM_001134395 | Homo sapiens chromosome 7 open reading frame 50 (C7orf50), transcript variant 2, mRNA. | N/A |

TABLE 4-continued

| Gene name | Exon overlap | SEQ ID No | RefSeq Accession Number | mRNA Description | RefSeq Summary |
|---|---|---|---|---|---|
| C7orf50 | N | 1011 | NM_001134396 | *Homo sapiens* chromosome 7 open reading frame 50 (C7orf50), transcript variant 3, mRNA. | N/A |
| C7orf50 | N | 1012 | NM_032350 | *Homo sapiens* chromosome 7 open reading frame 50 (C7orf50), transcript variant 1, mRNA. | N/A |
| SLC39A11 | N | 1013 | NM_001159770 | *Homo sapiens* solute carrier family 39 (metal ion transporter), member 11 (SLC39A11), transcript variant 1, mRNA. | N/A |
| SLC39A11 | N | 1014 | NM_139177 | *Homo sapiens* solute carrier family 39 (metal ion transporter), member 11 (SLC39A11), transcript variant 2, mRNA. | N/A |
| CDH17 | N | 1015 | NM_001144663 | *Homo sapiens* cadherin 17, LI cadherin (liver-intestine) (CDH17), transcript variant 2, mRNA. | This gene is a member of the cadherin superfamily, genes encoding calcium-dependent, membrane-associated glycoproteins. The encoded protein is cadherin-like, consisting of an extracellular region, containing 7 cadherin domains, and a transmembrane region but lacking the conserved cytoplasmic domain. The protein is a component of the gastrointestinal tract and pancreatic ducts, acting as an intestinal proton-dependent peptide transporter in the first step in oral absorption of many medically important peptide-based drugs. The protein may also play a role in the morphological organization of liver and intestine. Alternative splicing results in multiple transcript variants. [provided by RefSeq, January 2009]. Transcript Variant: This variant (2) differs in the 5' UTR compared to variant 1. Both variants 1 and 2 encode the same protein. |
| CDH17 | N | 1016 | NM_004063 | *Homo sapiens* cadherin 17, LI cadherin (liver-intestine) (CDH17), transcript variant 1, mRNA. | This gene is a member of the cadherin superfamily, genes encoding calcium-dependent, membrane-associated glycoproteins. The encoded protein is cadherin-like, consisting of an extracellular region, containing 7 cadherin domains, and a transmembrane region but lacking the conserved cytoplasmic domain. The protein is a component of the gastrointestinal tract and pancreatic ducts, acting as an intestinal proton-dependent peptide transporter in the first step in oral absorption of many medically important peptide-based drugs. The protein may also play a role in the morphological organization of liver and intestine. Alternative splicing results in multiple transcript variants. [provided by RefSeq, January 2009]. Transcript Variant: This variant (1) represents the longer transcript. Both variants 1 and 2 encode the same protein. |
| OR51A2 | Y | 1017 | NM_001004748 | *Homo sapiens* olfactory receptor, family 51, subfamily A, member 2 (OR51A2), mRNA. | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, July 2008]. |
| SFMBT1 | N | 1018 | NM_001005158 | *Homo sapiens* Scm-like with four mbt domains 1 (SFMBT1), transcript variant 2, mRNA. | This gene shares high similarity with the *Drosophila* Scm (sex comb on midleg) gene. It encodes a protein which contains four malignant brain tumor repeat (mbt) domains and may be involved in antigen recognition. Several alternative splice variants that encode the same protein have been characterized. [provided by RefSeq, August 2010]. Transcript Variant: This variant (2) differs in the 5' UTR, compared to variant 1. Variants 1, 2 and 3 encode the same protein. Sequence Note: This RefSeq record was created from transcript and genomic sequence data to make the sequence consistent with |

TABLE 4-continued

| Gene name | Exon overlap | SEQ ID No | RefSeq Accession Number | mRNA Description | RefSeq Summary |
|---|---|---|---|---|---|
| SFMBT1 | N | 1019 | NM_001005159 | Homo sapiens Scm-like with four mbt domains 1 (SFMBT1), transcript variant 1, mRNA. | the reference genome assembly. The genomic coordinates used for the transcript record were based on transcript alignments. This gene shares high similarity with the *Drosophila* Scm (sex comb on midleg) gene. It encodes a protein which contains four malignant brain tumor repeat (mbt) domains and may be involved in antigen recognition. Several alternative splice variants that encode the same protein have been characterized. [provided by RefSeq, August 2010]. Transcript Variant: This variant (1) represents the longest transcript. Variants 1, 2 and 3 encode the same protein. Sequence Note: This RefSeq record was created from transcript and genomic sequence data to make the sequence consistent with the reference genome assembly. The genomic coordinates used for the transcript record were based on transcript alignments. |
| SFMBT1 | N | 1020 | NM_016329 | Homo sapiens Scm-like with four mbt domains 1 (SFMBT1), transcript variant 3, mRNA. | This gene shares high similarity with the *Drosophila* Scm (sex comb on midleg) gene. It encodes a protein which contains four malignant brain tumor repeat (mbt) domains and may be involved in antigen recognition. Several alternative splice variants that encode the same protein have been characterized. [provided by RefSeq, August 2010]. Transcript Variant: This variant (3) differs in the 5' UTR, compared to variant 1. Variants 1, 2 and 3 encode the same protein. Sequence Note: This RefSeq record was created from transcript and genomic sequence data to make the sequence consistent with the reference genome assembly. The genomic coordinates used for the transcript record were based on transcript alignments. |
| RPSAP58 | N | 1021 | NR_003662 | Homo sapiens ribosomal protein SA pseudogene 58 (RPSAP58), non-coding RNA. | N/A |
| ZDHHC8 | Y | 1022 | NM_001185024 | Homo sapiens zinc finger, DHHC-type containing 8 (ZDHHC8), transcript variant 1, mRNA. | This gene encodes a four transmembrane protein that is a member of the zinc finger DHHC domain-containing protein family. The encoded protein may function as a palmitoyltransferase. Defects in this gene may be associated with a susceptibility to schizophrenia. Alternate splicing of this gene results in multiple transcript variants. A pseudogene of this gene is found on chromosome 22. [provided by RefSeq, May 2010]. Transcript Variant: This variant (1) encodes the longer isoform (1). Publication Note: This RefSeq record includes a subset of the publications that are available for this gene. Please see the Gene record to access additional publications. |
| ZDHHC8 | both | 1022 | NM_001185024 | Homo sapiens zinc finger, DHHC-type containing 8 (ZDHHC8), transcript variant 1, mRNA. | This gene encodes a four transmembrane protein that is a member of the zinc finger DHHC domain-containing protein family. The encoded protein may function as a palmitoyltransferase. Defects in this gene may be associated with a susceptibility to schizophrenia. Alternate splicing of this gene results in multiple transcript variants. A pseudogene of this gene is found on chromosome 22. [provided by RefSeq, May 2010]. Transcript Variant: This variant (1) encodes the longer isoform (1). Publication Note: This RefSeq record includes a subset of the publications that are available for this gene. Please see the Gene record to access additional publications. |
| ZDHHC8 | Y | 1023 | NM_013373 | Homo sapiens zinc finger, DHHC-type containing 8 (ZDHHC8), transcript variant 2, mRNA. | This gene encodes a four transmembrane protein that is a member of the zinc finger DHHC domain-containing protein family. The encoded protein may function as a palmitoyltransferase. Defects in this gene may be associated with a susceptibility to schizophrenia. Alternate splicing of this gene results in multiple transcript variants. A pseudogene of this gene is found on chromosome 22. [provided by RefSeq, May 2010]. Transcript Variant: This variant (2) uses an alternate splice site in the 3 coding region, which results in a frameshift, compared to variant 1. It encodes isoform 2, which has a shorter and distinct C-terminus, compared to isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |

TABLE 4-continued

| Gene name | Exon overlap | SEQ ID No | RefSeq Accession Number | mRNA Description | RefSeq Summary |
|---|---|---|---|---|---|
| ZDHHC8 | both | 1023 | NM_013373 | *Homo sapiens* zinc finger, DHHC-type containing 8 (ZDHHC8), transcript variant 2, mRNA. | This gene encodes a four transmembrane protein that is a member of the zinc finger DHHC domain-containing protein family. The encoded protein may function as a palmitoyltransferase. Defects in this gene may be associated with a susceptibility to schizophrenia. Alternate splicing of this gene results in multiple transcript variants. A pseudogene of this gene is found on chromosome 22. [provided by RefSeq, May 2010]. Transcript Variant: This variant (2) uses an alternate splice site in the 3' coding region, which results in a frameshift, compared to variant 1. It encodes isoform 2, which has a shorter and distinct C-terminus, compared to isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| ARVCF | Y | 1024 | NM_001670 | *Homo sapiens* armadillo repeat gene deleted in velocardiofacial syndrome (ARVCF), mRNA. | Armadillo Repeat gene deleted in Velo-Cardio-Facial syndrome (ARVCF) is a member of the catenin family. This family plays an important role in the formation of adherens junction complexes, which are thought to facilitate communication between the inside and outside environments of a cell. The ARVCF gene was isolated in the search for the genetic defect responsible for the autosomal dominant Velo-Cardio-Facial syndrome (VCFS), a relatively common human disorder with phenotypic features including cleft palate, conotruncal heart defects and facial dysmorphology. The ARVCF gene encodes a protein containing two motifs, a coiled coil domain in the N-terminus and a 10 armadillo repeat sequence in the midregion. Since these sequences can facilitate protein-protein interactions ARVCF is thought to function in a protein complex. In addition, ARVCF contains a predicted nuclear-targeting sequence suggesting that it may have a function as a nuclear protein. [provided by RefSeq, June 2010]. Publication Note: This RefSeq record includes a subset of the publications that are available for this gene. Please see the Gene record to access additional publications. |
| C22orf25 | Y | 1025 | NM_152906 | *Homo sapiens* chromosome 22 open reading frame 25 (C22orf25), mRNA. | N/A |
| C22orf29 | Y | 1026 | NM_024627 | *Homo sapiens* chromosome 22 open reading frame 29 (C22orf29), mRNA. | N/A |
| C22orf39 | Y | 1027 | NM_001166242 | *Homo sapiens* chromosome 22 open reading frame 39 (C22orf39), transcript variant 2, mRNA. | N/A |
| C22orf39 | Y | 1028 | NM_173793 | *Homo sapiens* chromosome 22 open reading frame 39 (C22orf39), transcript variant 1, mRNA. | N/A |
| CDC45 | Y | 1029 | NM_001178010 | *Homo sapiens* cell division cycle 45 homolog (*S. cerevisiae*) (CDC45), transcript variant 1, mRNA. | The protein encoded by this gene was identified by its strong similarity with *Saccharomyces cerevisiae* Cdc45, an essential protein required to the initiation of DNA replication. Cdc45 is a member of the highly conserved multiprotein complex including Cdc6/Cdc18, the minichromosome maintenance proteins (MCMs) and DNA polymerase, which is important for early steps of DNA replication in eukaryotes. This protein has been shown to interact with MCM7 and DNA polymerase alpha. Studies of the similar gene in Xenopus suggested that this protein play a pivotal role in the loading of DNA polymerase alpha onto chromatin. Multiple alternatively spliced transcript variants encoding different isoforms have been found for this gene. [provided by RefSeq, May 2010]. Transcript Variant: This variant (1) encodes the longest isoform (1). Publication Note: This RefSeq record includes a subset of the publications that are available for this gene. Please see the Gene record to access additional publications. |

TABLE 4-continued

| Gene name | Exon overlap | SEQ ID No | RefSeq Accession Number | mRNA Description | RefSeq Summary |
|---|---|---|---|---|---|
| CDC45 | Y | 1030 | NM_001178011 | Homo sapiens cell division cycle 45 homolog (S. cerevisiae) (CDC45), transcript variant 3, mRNA. | The protein encoded by this gene was identified by its strong similarity with Saccharomyces cerevisiae Cdc45, an essential protein required to the initiation of DNA replication. Cdc45 is a member of the highly conserved multiprotein complex including Cdc6/Cdc18, the minichromosome maintenance proteins (MCMs) and DNA polymerase, which is important for early steps of DNA replication in eukaryotes. This protein has been shown to interact with MCM7 and DNA polymerase alpha. Studies of the similar gene in Xenopus suggested that this protein play a pivotal role in the loading of DNA polymerase alpha onto chromatin. Multiple alternatively spliced transcript variants encoding different isoforms have been found for this gene. [provided by RefSeq, May 2010]. Transcript Variant: This variant (3) lacks two in-frame exons in the CDS, as compared to variant 1. The resulting isoform (3) lacks two internal segments, as compared to isoform 1. Publication Note: This RefSeq record includes a subset of the publications that are available for this gene. Please see the Gene record to access additional publications. |
| CDC45 | Y | 1031 | NM_003504 | Homo sapiens cell division cycle 45 homolog (S. cerevisiae) (CDC45), transcript variant 2, mRNA. | The protein encoded by this gene was identified by its strong similarity with Saccharomyces cerevisiae Cdc45, an essential protein required to the initiation of DNA replication. Cdc45 is a member of the highly conserved multiprotein complex including Cdc6/Cdc18, the minichromosome maintenance proteins (MCMs) and DNA polymerase, which is important for early steps of DNA replication in eukaryotes. This protein has been shown to interact with MCM7 and DNA polymerase alpha. Studies of the similar gene in Xenopus suggested that this protein play a pivotal role in the loading of DNA polymerase alpha onto chromatin. Multiple alternatively spliced transcript variants encoding different isoforms have been found for this gene. [provided by RefSeq, May 2010]. Transcript Variant: This variant (2) lacks an in-frame exon in the CDS, as compared to variant 1. The resulting isoform (2) lacks an internal segment, as compared to isoform 1. |
| CLDN5 | Y | 1032 | NM_001130861 | Homo sapiens claudin 5 (CLDN5), transcript variant 1, mRNa. | This gene encodes a member of the claudin family. Claudins are integral membrane proteins and components of tight junction strands. Tight junction strands serve as a physical barrier to prevent solutes and water from passing freely through the paracellular space between epithelial or endothelial cell sheets. Mutations in this gene have been found in patients with velocardiofacial syndrome. Alternatively spliced transcript variants encoding the same protein have been found for this gene. [provided by RefSeq, August 2008]. Transcript Variant: This variant (1) is intronless. Both variants 1 and 2 encode the same protein. |
| CLDN5 | Y | 1033 | NM_003277 | Homo sapiens claudin 5 (CLDN5), transcript variant 2, mRNA. | This gene encodes a member of the claudin family. Claudins are integral membrane proteins and components of tight junction strands. Tight junction strands serve as a physical barrier to prevent solutes and water from passing freely through the paracellular space between epithelial or endothelial cell sheets. Mutations in this gene have been found in patients with velocardiofacial syndrome. Alternatively spliced transcript variants encoding the same protein have been found for this gene. [provided by RefSeq, August 2008]. Transcript Variant: This variant (2) lacks a segment in the 5' UTR, as compared to variant 1. |
| CLTCL1 | Y | 1034 | NM_001835 | Homo sapiens clathrin, heavy chain-like 1 (CLTCL1), transcript variant 2, mRNA. | This gene is a member of the clathrin heavy chain family and encodes a major protein of the polyhedral coat of coated pits and vesicles. Chromosomal aberrations involving this gene are associated with meningioma, DiGeorge syndrome, and velo-cardio-facial syndrome. Multiple transcript variants encoding different isoforms have been found for this gene. [provided by RefSeq, June 2009]. Transcript Variant: This variant (2) lacks an alternate in-frame exon in the 3' coding region, compared to variant 1. The resulting isoform (2) lacks an internal segment near the C-terminus, compared to isoform 1. |
| CLTCL1 | Y | 1035 | NM_007098 | Homo sapiens clathrin, heavy chain-like 1 (CLTCL1), transcript variant 1, mRNA. | This gene is a member of the clathrin heavy chain family and encodes a major protein of the polyhedral coat of coated pits and vesicles. Chromosomal aberrations involving this gene are associated with meningioma, DiGeorge syndrome, and velo-cardio-facial syndrome. Multiple transcript variants encoding different isoforms have been found for this gene. [provided by RefSeq, June 2009]. Transcript Variant: This variant (1) represents the longer transcript and encodes the longer isoform (1). |

TABLE 4-continued

| Gene name | Exon overlap | SEQ ID No | RefSeq Accession Number | mRNA Description | RefSeq Summary |
|---|---|---|---|---|---|
| COMT | Y | 1036 | NM_000754 | *Homo sapiens* catechol-O-methyltransferase (COMT), transcript variant 1, mRNA. | Catechol-O-methyltransferase catalyzes the transfer of a methyl group from S-adenosylmethionine to catecholamines, including the neurotransmitters dopamine, epinephrine, and norepinephrine. This O-methylation results in one of the major degradative pathways of the catecholamine transmitters. In addition to its role in the metabolism of endogenous substances, COMT is important in the metabolism of catechol drugs used in the treatment of hypertension, asthma, and Parkinson disease. COMT is found in two forms in tissues, a soluble form (S-COMT) and a membrane-bound form (MB-COMT). The differences between S-COMT and MB-COMT reside within the N-termini. Several transcript variants are formed through the use of alternative translation initiation sites and promoters. [provided by RefSeq, September 2008]. Transcript Variant: This variant (1, also known as MB-COMT) represents the longest transcript and encodes the longer isoform (MB-COMT). Variants 1, 2, and 3 all encode isoform MB-COMT and may also make the shorter isoform S-COMT at a low level. MB-COMT is a membrane-bound protein. Sequence Note: This RefSeq record was created from transcript and genomic sequence data because no single transcript was available for the full length of the gene. The extent of this transcript is supported by transcript alignments. |
| COMT | Y | 1037 | NM_001135161 | *Homo sapiens* catechol-O-methyltransferase (COMT), transcript variant 2, mRNA. | Catechol-O-methyltransferase catalyzes the transfer of a methyl group from S-adenosylmethionine to catecholamines, including the neurotransmitters dopamine, epinephrine, and norepinephrine. This O-methylation results in one of the major degradative pathways of the catecholamine transmitters. In addition to its role in the metabolism of endogenous substances, COMT is important in the metabolism of catechol drugs used in the treatment of hypertension, asthma, and Parkinson disease. COMT is found in two forms in tissues, a soluble form (S-COMT) and a membrane-bound form (MB-COMT). The differences between S-COMT and MB-COMT reside within the N-termini. Several transcript variants are formed through the use of alternative translation initiation sites and promoters. [provided by RefSeq, September 2008]. Transcript Variant: This variant (2) differs in the 5' UTR compared to variant 1. Variants 1, 2, and 3 all encode isoform MB-COMT and may also make the shorter isoform S-COMT at a low level. MB-COMT is a membrane-bound protein. Sequence Note: This RefSeq record was created from transcript and genomic sequence data because no single transcript was available for the full length of the gene. The extent of this transcript is supported by transcript alignments. |
| COMT | Y | 1038 | NM_001135162 | *Homo sapiens* catechol-O-methyltransferase (COMT), transcript variant 3, mRNA. | Catechol-O-methyltransferase catalyzes the transfer of a methyl group from S-adenosylmethionine to catecholamines, including the neurotransmitters dopamine, epinephrine, and norepinephrine. This O-methylation results in one of the major degradative pathways of the catecholamine transmitters. In addition to its role in the metabolism of endogenous substances, COMT is important in the metabolism of catechol drugs used in the treatment of hypertension, asthma, and Parkinson disease. COMT is found in two forms in tissues, a soluble form (S-COMT) and a membrane-bound form (MB-COMT). The differences between S-COMT and MB-COMT reside within the N-termini. Several transcript variants are formed through the use of alternative translation initiation sites and promoters. [provided by RefSeq, September 2008]. Transcript Variant: This variant (3) differs in the 5 UTR compared to variant 1. Variants 1, 2, and 3 all encode isoform MB-COMT and may also make the shorter isoform S-COMT at a low level. MB-COMT is a membrane-bound protein. Sequence Note: This RefSeq record was created from transcript and genomic sequence data because no single transcript was available for the full length of the gene. The extent of this transcript is supported by transcript alignments. |
| COMT | Y | 1039 | NM_007310 | *Homo sapiens* catechol-O-methyltransferase (COMT), transcript variant 4, mRNA. | Catechol-O-methyltransferase catalyzes the transfer of a methyl group from S-adenosylmethionine to catecholamines, including the neurotransmitters dopamine, epinephrine, and norepinephrine. This O-methylation results in one of the major degradative pathways of the catecholamine transmitters. In addition to its role in the metabolism of endogenous substances, COMT is important in the metabolism of catechol drugs used in the treatment of hypertension, asthma, and Parkinson disease. COMT is found in two forms in tissues, a soluble form (S-COMT) and a membrane-bound form (MB-COMT). The differences between S-COMT and MB-COMT reside within the N-termini. Several transcript variants are formed through the use of alternative translation initiation sites and promoters. [provided by RefSeq, September 2008]. Transcript Variant: This variant (4, also known as S-COMT) contains a shorter |

TABLE 4-continued

| Gene name | Exon overlap | SEQ ID No | RefSeq Accession Number | mRNA Description | RefSeq Summary |
|---|---|---|---|---|---|
| | | | | | 5' UTR and a translation start site which lies 50 codons downstream compared to that of variant 1. The resulting isoform (S-COMT) is shorter at the N-terminus compared to isoform MB-COMT. S-COMT is a soluble protein. Sequence Note: This RefSeq record was created from transcript and genomic sequence data because no single transcript was available for the full length of the gene. The extent of this transcript is supported by transcript alignments. |
| CRKL | Y | 1040 | NM_005207 | *Homo sapiens* v-crk sarcoma virus CT10 oncogene homolog (avian)-like (CRKL), mRNA. | This gene encodes a protein kinase containing SH2 and SH3 (src homology) domains which has been shown to activate the RAS and JUN kinase signaling pathways and transform fibroblasts in a RAS-dependent fashion. It is a substrate of the BCR-ABL tyrosine kinase, plays a role in fibroblast transformation by BCR-ABL, and may be oncogenic. [provided by RefSeq, January 2009]. |
| CRKL | both | 1040 | NM_005207 | *Homo sapiens* v-crk sarcoma virus CT10 oncogene homolog (avian)-like (CRKL), mRNA. | This gene encodes a protein kinase containing SH2 and SH3 (src homology) domains which has been shown to activate the RAS and JUN kinase signaling pathways and transform fibroblasts in a RAS-dependent fashion. It is a substrate of the BCR-ABL tyrosine kinase, plays a role in fibroblast transformation by BCR-ABL, and may be oncogenic. [provided by RefSeq, January 2009]. |
| DGCR11 | Y | 1041 | NR_024157 | *Homo sapiens* DiGeorge syndrome critical region gene 11 (DGCR11), non-coding RNA. | N/A |
| DGCR14 | Y | 1042 | NM_022719 | *Homo sapiens* DiGeorge syndrome critical region gene 14 (DGCR14), mRNA. | This gene is located within the minimal DGS critical region (MDGCR) thought to contain the gene(s) responsible for a group of developmental disorders. These disorders include DiGeorge syndrome, velocardiofacial syndrome, conotruncal anomaly face syndrome, and some familial or sporadic conotruncal cardiac defects which have been associated with microdeletion of 22q11.2. The encoded protein may be a component of C complex spliceosomes, and the orthologous protein in the mouse localizes to the nucleus. [provided by RefSeq, July 2008]. |
| DGCR2 | Y | 1043 | NM_001173533 | *Homo sapiens* DiGeorge syndrome critical region gene 2 (DGCR2), transcript variant 2, mRNA. | Deletions of the 22q11.2 have been associated with a wide range of developmental defects (notably DiGeorge syndrome, velocardiofacial syndrome, conotruncal anomaly face syndrome and isolated conotruncal cardiac defects) classified under the acronym CATCH 22. The DGCR2 gene encodes a novel putative adhesion receptor protein, which could play a role in neural crest cells migration, a process which has been proposed to be altered in DiGeorge syndrome. Alternative splicing results in multiple transcript variants. [provided by RefSeq, May 2010]. Transcript Variant: This variant (2) lacks an alternate in-frame exon in the 5' coding region, compared to variant 1. The resulting isoform (2) lacks an internal segment, compared to isoform 1. |
| DGCR2 | Y | 1044 | NM_001173534 | *Homo sapiens* DiGeorge syndrome critical region gene 2 (DGCR2), transcript variant 3, mRNA. | Deletions of the 22q11.2 have been associated with a wide range of developmental defects (notably DiGeorge syndrome, velocardiofacial syndrome, conotruncal anomaly face syndrome and isolated conotruncal cardiac defects) classified under the acronym CATCH 22. The DGCR2 gene encodes a novel putative adhesion receptor protein, which could play a role in neural crest cells migration, a process which has been proposed to be altered in DiGeorge syndrome. Alternative splicing results in multiple transcript variants. [provided by RefSeq, May 2010]. Transcript Variant: This variant (3) lacks an alternate in-frame exon and uses an alternate in-frame splice site in the 5' coding region, compared to variant 1. The resulting isoform (3) lacks two internal segments, compared to isoform 1. Publication Note: This RefSeq record includes a subset of the publications that are available for this gene. Please see the Gene record to access additional publications. |
| DGCR2 | Y | 1045 | NM_001184781 | *Homo sapiens* DiGeorge syndrome critical region gene 2 (DGCR2), transcript variant 4, mRNA. | Deletions of the 22q11.2 have been associated with a wide range of developmental defects (notably DiGeorge syndrome, velocardiofacial syndrome, conotruncal anomaly face syndrome and isolated conotruncal cardiac defects) classified under the acronym CATCH 22. The DGCR2 gene encodes a novel putative adhesion receptor protein, which could play a role in neural crest cells migration, a process which has been proposed to be altered in DiGeorge syndrome. Alternative splicing results in multiple transcript variants. [provided by RefSeq, May 2010]. Transcript Variant: This variant (4) uses an alternate in-frame splice site in the 5' coding region, compared to variant 1. The resulting isoform (4) lacks a short internal segment, compared to isoform 1. |

TABLE 4-continued

| Gene name | Exon overlap | SEQ ID No | RefSeq Accession Number | mRNA Description | RefSeq Summary |
|---|---|---|---|---|---|
| DGCR2 | Y | 1046 | NM_005137 | *Homo sapiens* DiGeorge syndrome critical region gene 2 (DGCR2), transcript variant 1, mRNA. | Deletions of the 22q11.2 have been associated with a wide range of developmental defects (notably DiGeorge syndrome, velocardiofacial syndrome, conotruncal anomaly face syndrome and isolated conotruncal cardiac defects) classified under the acronym CATCH 22. The DGCR2 gene encodes a novel putative adhesion receptor protein, which could play a role in neural crest cells migration, a process which has been proposed to be altered in DiGeorge syndrome. Alternative splicing results in multiple transcript variants. [provided by RefSeq, May 2010]. Transcript Variant: This variant (1) represents the longest transcript and encodes the longest isoform (1). |
| DGCR2 | Y | 1047 | NM_033674 | *Homo sapiens* DiGeorge syndrome critical region gene 2 (DGCR2), transcript variant 5, non-coding RNA. | Deletions of the 22q11.2 have been associated with a wide range of developmental defects (notably DiGeorge syndrome, velocardiofacial syndrome, conotruncal anomaly face syndrome and isolated conotruncal cardiac defects) classified under the acronym CATCH 22. The DGCR2 gene encodes a novel putative adhesion receptor protein, which could play a role in neural crest cells migration, a process which has been proposed to be altered in DiGeorge syndrome. Alternative splicing results in multiple transcript variants. [provided by RefSeq, May 2010]. Transcript Variant: This variant (5) lacks an alternate in-frame exon and uses an alternate in-frame splice site in the 5' coding region, compared to variant 1, which results in a frameshift and early stop codon. The transcript is sufficiently abundant to represent as a RefSeq record; however, the predicted protein is not represented because the product is significantly truncated and the transcript is a candidate for nonsense-mediated mRNA decay (NMD). Publication Note: This RefSeq record includes a subset of the publications that are available for this gene. Please see the Gene record to access additional publications. |
| DGCR8 | Y | 1048 | NM_001190326 | *Homo sapiens* DiGeorge syndrome critical region gene 8 (DGCR8), transcript variant 2, mRNA. | This gene encodes a subunit of the microprocessor complex which mediates the biogenesis of microRNAs from the primary microRNA transcript. The encoded protein is a double-stranded RNA binding protein that functions as the non-catalytic subunit of the microprocessor complex. This protein is required for binding the double-stranded RNA substrate and facilitates cleavage of the RNA by the ribonuclease III protein, Drosha. Alternate splicing results in multiple transcript variants. [provided by RefSeq, June 2010]. Transcript Variant: This variant (2) lacks an in-frame exon in the coding region, compared to variant 1. The encoded isoform (2) is shorter than isoform 1. Publication Note: This RefSeq record includes a subset of the publications that are available for this gene. Please see the Gene record to access additional publications. |
| DGCR8 | Y | 1049 | NM_022720 | *Homo sapiens* DiGeorge syndrome critical region gene 8 (DGCR8), transcript variant 1, mRNA. | This gene encodes a subunit of the microprocessor complex which mediates the biogenesis of microRNAs from the primary microRNA transcript. The encoded protein is a double-stranded RNA binding protein that functions as the non-catalytic subunit of the microprocessor complex. This protein is required for binding the double-stranded RNA substrate and facilitates cleavage of the RNA by the ribonuclease III protein, Drosha. Alternate splicing results in multiple transcript variants. [provided by RefSeq, June 2010]. Transcript Variant: This variant (1) represents the longer transcript and encodes the longer isoform (1). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| GNB1L | Y | 1050 | NM_053004 | *Homo sapiens* guanine nucleotide binding protein (G protein), beta polypeptide 1-like (GNB1L), mRNA. | This gene encodes a G-protein beta-subunit-like polypeptide which is a member of the WD repeat protein family. WD repeats are minimally conserved regions of approximately 40 amino acids typically bracketed by gly-his and trp-asp (GH-WD), which may facilitate formation of heterotrimeric or multiprotein complexes. Members of this family are involved in a variety of cellular processes, including cell cycle progression, signal transduction, apoptosis, and gene regulation. This protein contains 6 WD repeats and is highly expressed in the heart. The gene maps to the region on chromosome 22q11, which is deleted in DiGeorge syndrome, trisomic in derivative 22 syndrome and tetrasomic in cat-eye syndrome. Therefore, this gene may contribute to the etiology of those disorders. |

TABLE 4-continued

| Gene name | Exon overlap | SEQ ID No | RefSeq Accession Number | mRNA Description | RefSeq Summary |
|---|---|---|---|---|---|
| | | | | | Transcripts from this gene share exons with some transcripts from the C22orf29 gene. [provided by RefSeq, July 2008]. Publication Note: This RefSeq record includes a subset of the publications that are available for this gene. Please see the Gene record to access additional publications. |
| GP1BB | Y | 1051 | NM_000407 | Homo sapiens glycoprotein Ib (platelet), beta polypeptide (GP1BB), mRNA. | Platelet glycoprotein Ib (GPIb) is a heterodimeric transmembrane protein consisting of a disulfide-linked 140 kD alpha chain and 22 kD beta chain. It is part of the GPIb-V-IX system that constitutes the receptor for von Willebrand factor (VWF), and mediates platelet adhesion in the arterial circulation. GPIb alpha chain provides the VWF binding site, and GPIb beta contributes to surface expression of the receptor and participates in transmembrane signaling through phosphorylation of its intracellular domain. Mutations in the GPIb beta subunit have been associated with Bernard-Soulier syndrome, velocardiofacial syndrome and giant platelet disorder. The 206 amino acid precursor of GPIb beta is synthesized from a 1.0 kb mRNA expressed in platelets and megakaryocytes. A 411 amino acid protein arising from a longer, unspliced transcript in endothelial cells has been described; however, the authenticity of this product has been questioned. Yet another less abundant GPIb beta mRNA species of 3.5 kb, expressed in nonhematopoietic tissues such as endothelium, brain and heart, was shown to result from inefficient usage of a non-consensus polyA signal in the neighboring upstream gene (SEPT5, septin 5). In the absence of polyadenylation from its own imperfect site, the SEPT5 gene produces read-through transcripts that use the consensus polyA signal of this gene. [provided by RefSeq, December 2010]. Sequence Note: This RefSeq record was created from genomic sequence data to make the sequence consistent with the reference genome assembly. The genomic coordinates used for the transcript record were based on transcript alignments. |
| GSC2 | Y | 1052 | NM_005315 | Homo sapiens goosecoid homeobox 2 (GSC2), mRNA. | Goosecoid-like (GSCL), a homeodomain-containing gene, resides in the critical region for VCFS/DGS on 22q11. Velocardiofacial syndrome (VCFS) is a developmental disorder characterized by conotruncal heart defects, craniofacial anomalies, and learning disabilities. VCFS is phenotypically related to DiGeorge syndrome (DGS) and both syndromes are associated with hemizygous 22q11 deletions. Because many of the tissues and structures affected in VCFS/DGS derive from the pharyngeal arches of the developing embryo, it is believed that haploinsufficiency of a gene involved in embryonic development may be responsible for its etiology. The gene is expressed in a limited number of adult tissues, as well as in early human development. [provided by RefSeq, July 2008]. Sequence Note: This RefSeq record was created from genomic sequence data because no single transcript was available for the full length of the gene. The extent of this transcript is supported by experimental evidence. |
| HIRA | Y | 1053 | NM_003325 | Homo sapiens HIR histone cell cycle regulation defective homolog A (S. cerevisiae) (HIRA), mRNA. | This gene encodes a histone chaperone that preferentially places the variant histone H3.3 in nucleosomes. Orthologs of this gene in yeast, flies, and plants are necessary for the formation of transcriptionally silent heterochromatin. This gene plays an important role in the formation of the senescence-associated heterochromatin foci. These foci likely mediate the irreversible cell cycle changes that occur in senescent cells. It is considered the primary candidate gene in some haploinsufficiency syndromes such as DiGeorge syndrome, and insufficient production of the gene may disrupt normal embryonic development. [provided by RefSeq, July 2008]. |
| LOC150185 | Y | 1054 | NR_024381 | Homo sapiens uncharacterized LOC150185 (LOC150185), non-coding RNA. | N/A |
| MIR1306 | Y | 1055 | NR_031706 | Homo sapiens microRNA 1306 (MIR1306), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is |

TABLE 4-continued

| Gene name | Exon overlap | SEQ ID No | RefSeq Accession Number | mRNA Description | RefSeq Summary |
|---|---|---|---|---|---|
| MIR185 | Y | 1056 | NR_029706 | Homo sapiens microRNA 185 (MIR185), microRNA. | incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MIR3618 | Y | 1057 | NR_037412 | Homo sapiens microRNA 3618 (MIR3618), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MRPL40 | Y | 1058 | NM_003776 | Homo sapiens mitochondrial ribosomal protein L40 (MRPL40), nuclear gene encoding mitochondrial protein, mRNA. | Mammalian mitochondrial ribosomal proteins are encoded by nuclear genes and help in protein synthesis within the mitochondrion. Mitochondrial ribosomes (mitoribosomes) consist of a small 28S subunit and a large 39S subunit. They have an estimated 75% protein to rRNA composition compared to prokaryotic ribosomes, where this ratio is reversed. Another difference between mammalian mitoribosomes and prokaryotic ribosomes is that the latter contain a 5S rRNA. Among different species, the proteins comprising the mitoribosome differ greatly in sequence, and sometimes in biochemical properties, which prevents easy recognition by sequence homology. This gene encodes a 39S subunit protein. Deletions in this gene may contribute to the etiology of velo-cardio-facial syndrome and DiGeorge syndrome. [provided by RefSeq, July 2008]. |
| PI4KA | Y | 1059 | NM_002650 | Homo sapiens phosphatidylinositol 4-kinase, catalytic, alpha (PI4KA), transcript variant 2, mRNA. | This gene encodes a phosphatidylinositol (PI) 4-kinase which catalyzes the first committed step in the biosynthesis of phosphatidylinositol 4,5-bisphosphate. The mammalian PI 4-kinases have been classified into two types, II and III, based on their molecular mass, and modulation by detergent and adenosine. The protein encoded by this gene is a type III enzyme that is not inhibited by adenosine. Two transcript variants encoding different isoforms have been described for this gene. [provided by RefSeq, July 2008]. Transcript Variant: This variant (2) differs in the 5' UTR and CDS compared to variant 1. The resulting isoform (2) is shorter at the N-terminus compared to isoform 1. |

TABLE 4-continued

| Gene name | SEQ ID No | Exon overlap | RefSeq Accession Number | mRNA Description | RefSeq Summary |
|---|---|---|---|---|---|
| PI4KA | 1060 | Y | NM_058004 | *Homo sapiens* phosphatidylinositol 4-kinase, catalytic, alpha (PI4KA), transcript variant 1, mRNA. | This gene encodes a phosphatidylinositol (PI) 4-kinase which catalyzes the first committed step in the biosynthesis of phosphatidylinositol 4,5-bisphosphate. The mammalian PI 4-kinases have been classified into two types, II and III, based on their molecular mass, and modulation by detergent and adenosine. The protein encoded by this gene is a type III enzyme that is not inhibited by adenosine. Two transcript variants encoding different isoforms have been described for this gene. [provided by RefSeq, July 2008]. Transcript Variant: This variant (1) represents the longer transcript and encodes the longer isoform (1). |
| RANBP1 | 1061 | Y | NM_002882 | *Homo sapiens* RAN binding protein 1 (RANBP1), mRNA. | Ran/TC4-binding protein, RanBP1, interacts specifically with GTP-charged RAN. RANBP1 encodes a 23-kD protein that binds to RAN complexed with GTP but not GDP. RANBP1 does not activate GTPase activity of RAN but does markedly increase GTP hydrolysis by the RanGTPase-activating protein (RanGAP1). The RANBP1 cDNA encodes a 201-amino acid protein that is 92% similar to its mouse homolog. In both mammalian cells and in yeast, RANBP1 acts as a negative regulator of RCC1 by inhibiting RCC1-stimulated guanine nucleotide release from RAN. [provided by RefSeq, July 2008]. |
| SEPT5 | 1062 | Y | NM_001009939 | *Homo sapiens* septin 5 (SEPT5), transcript variant 2, mRNA. | This gene is a member of the septin gene family of nucleotide binding proteins, originally described in yeast as cell division cycle regulatory proteins. Septins are highly conserved in yeast, *Drosophila*, and mouse and appear to regulate cytoskeletal organization. Disruption of septin function disturbs cytokinesis and results in large multinucleate or polyploid cells. This gene is mapped to 22q11, the region frequently deleted in DiGeorge and velocardiofacial syndromes. A translocation involving the MLL gene and this gene has also been reported in patients with acute myeloid leukemia. Alternative splicing results in multiple transcript variants. The presence of a non-consensus polyA signal (AACAAT) in this gene also results in read-through transcription into the downstream neighboring gene (GP1BB; platelet glycoprotein Ib), whereby larger, non-coding transcripts are produced. [provided by RefSeq, December 2010]. Transcript Variant: This variant (2) differs in the 5' UTR, lacks a portion of the 5' coding region, and uses an alternate start codon, compared to variant 1. The encoded isoform 2 has a shorter and distinct N-terminus, compared to isoform 1. Publication Note: This RefSeq record includes a subset of the publications that are available for this gene. Please see the Gene record to access additional publications. |
| SEPT5 | 1063 | Y | NM_002688 | *Homo sapiens* septin 5 (SEPT5), transcript variant 1, mRNA. | This gene is a member of the septin gene family of nucleotide binding proteins, originally described in yeast as cell division cycle regulatory proteins. Septins are highly conserved in yeast, *Drosophila*, and mouse and appear to regulate cytoskeletal organization. Disruption of septin function disturbs cytokinesis and results in large multinucleate or polyploid cells. This gene is mapped to 22q11, the region frequently deleted in DiGeorge and velocardiofacial syndromes. A translocation involving the MLL gene and this gene has also been reported in patients with acute myeloid leukemia. Alternative splicing results in multiple transcript variants. The presence of a non-consensus polyA signal (AACAAT) in this gene also results in read-through transcription into the downstream neighboring gene (GP1BB; platelet glycoprotein Ib), whereby larger, non-coding transcripts are produced. [provided by RefSeq, December 2010]. Transcript Variant: This variant (1) encodes the longer isoform (1). Publication Note: This RefSeq record includes a subset of the publications that are available for this gene. Please see the Gene record to access additional publications. |
| SEPT5-GP1BB | 1064 | Y | NR_037611 | *Homo sapiens* SEPT5-GP1BB readthrough (SEPT5-GP1BB), non-coding RNA. | This locus represents naturally occurring read-through transcription between the neighboring SEPT5 (septin 5) and GP1BB (glycoprotein Ib (platelet), beta polypeptide) genes on chromosome 22. This read-through transcription arises from inefficient use of an imperfect polyA signal in the upstream SEPT5 gene, whereby transcription continues into the GP1BB gene. Alternative splicing results in multiple read-through variants. The read-through transcripts are candidates for nonsense-mediated mRNA decay (NMD), and are therefore unlikely to produce protein products. [provided by RefSeq, December 2010]. Sequence Note: This RefSeq record was created from transcript and genomic sequence data to make the sequence consistent with the reference genome assembly. The genomic coordinates used for the transcript record were based on transcript alignments. |

| Gene name | Exon overlap | SEQ ID No | RefSeq Accession Number | mRNA Description | RefSeq Summary |
|---|---|---|---|---|---|
| SEPT5-GP1BB | Y | 1065 | NR_037612 | *Homo sapiens* SEPT5-GP1BB readthrough (SEPT5-GP1BB), non-coding RNA. | This locus represents naturally occurring read-through transcription between the neighboring SEPT5 (septin 5) and GP1BB (glycoprotein Ib (platelet), beta polypeptide) genes on chromosome 22. This read-through transcription arises from inefficient use of an imperfect polyA signal in the upstream SEPT5 gene, whereby transcription continues into the GP1BB gene. Alternative splicing results in multiple read-through variants. The read-through transcripts are candidates for nonsense-mediated mRNA decay (NMD), and are therefore unlikely to produce protein products. [provided by RefSeq, December 2010]. |
| SERPIND1 | Y | 1066 | NM_000185 | *Homo sapiens* serpin peptidase inhibitor, clade D (heparin cofactor), member 1 (SERPIND1), mRNA. | The product encoded by this gene is a serine proteinase inhibitor which rapidly inhibits thrombin in the presence of dermatan sulfate or heparin. The gene contains five exons and four introns. This protein shares homology with antithrombin III and other members of the alpha 1-antitrypsin superfamily. Mutations in this gene are associated with heparin cofactor II deficiency. [provided by RefSeq, July 2008]. |
| SLC25A1 | Y | 1067 | NM_005984 | *Homo sapiens* solute carrier family 25 (mitochondrial carrier; citrate transporter), member 1 (SLC25A1), nuclear gene encoding mitochondrial protein, transcript variant 1, mRNA. | The mitochondrial tricarboxylate transporter (also called citrate transport protein, or CTP) is responsible for the movement of citrate across the mitochondrial inner membrane (Kaplan et al., 1993 [PubMed 8514800]). [supplied by OMIM, January 2011]. Transcript Variant: This variant (1) encodes a functional protein. |
| SLC25A1 | Y | 1068 | NR_033687 | *Homo sapiens* solute carrier family 25 (mitochondrial carrier; citrate transporter), member 1 (SLC25A1), transcript variant 2, non-coding RNA. | The mitochondrial tricarboxylate transporter (also called citrate transport protein, or CTP) is responsible for the movement of citrate across the mitochondrial inner membrane (Kaplan et al., 1993 [PubMed 8514800]). [supplied by OMIM, January 2011]. Transcript Variant: This variant (2) has an alternate 5' exon, as compared to variant 1. It includes a uORF which has a strong Kozak signal and overlaps the downstream ORF. It appears that this transcript is a nonsense-mediated mRNA decay candidate. |
| SNAP29 | Y | 1069 | NM_004782 | *Homo sapiens* synaptosomal-associated protein, 29 kDa (SNAP29), mRNA. | This gene, a member of the SNAP25 gene family, encodes a protein involved in multiple membrane trafficking steps. Two other members of this gene family, SNAP23 and SNAP25, encode proteins that bind a syntaxin protein and mediate synaptic vesicle membrane docking and fusion to the plasma membrane. The protein encoded by this gene binds tightly to multiple syntaxins and is localized to intracellular membrane structures rather than to the plasma membrane. While the protein is mostly membrane-bound, a significant fraction of it is found free in the cytoplasm. Use of multiple polyadenylation sites has been noted for this gene. [provided by RefSeq, July 2008]. Sequence Note: This RefSeq record was created from transcript and genomic sequence data because no single transcript was available for the full length of the gene. The extent of this transcript is supported by transcript alignments. |
| TBX1 | Y | 1070 | NM_005992 | *Homo sapiens* T-box 1 (TBX1), transcript variant B, mRNA. | This gene is a member of a phylogenetically conserved family of genes that share a common DNA-binding domain, the T-box. T-box genes encode transcription factors involved in the regulation of developmental processes. This gene product shares 98% amino acid sequence identity with the mouse ortholog. DiGeorge syndrome (DGS)/velocardiofacial syndrome (VCFS), a common congenital disorder characterized by neural-crest-related developmental defects, has been associated with deletions of chromosome 22q11.2, where this gene has been mapped. Studies using mouse models of DiGeorge syndrome suggest a major role for this gene in the molecular etiology of DGS/VCFS. Several alternatively spliced transcript variants encoding different isoforms have been described for this gene. [provided by RefSeq, July 2008]. Transcript Variant: This variant (B) contains an alternate exon 9 and an additional exon 10 compared to variant C. It encodes an isoform (B) with the same N-terminal 336 aa, but an unique C-terminus with respect to isoforms A and C. |
| TBX1 | Y | 1071 | NM_080646 | *Homo sapiens* T-box 1 (TBX1), transcript variant A, mRNA. | This gene is a member of a phylogenetically conserved family of genes that share a common DNA-binding domain, the T-box. T-box genes encode transcription factors involved in the regulation of developmental processes. This gene product shares 98% amino acid sequence identity with the mouse |

TABLE 4-continued

| Gene name | Exon overlap | SEQ ID No | RefSeq Accession Number | mRNA Description | RefSeq Summary |
|---|---|---|---|---|---|
| TBX1 | Y | 1072 | NM_080647 | *Homo sapiens* T-box 1 (TBX1), transcript variant C, mRNA. | ortholog. DiGeorge syndrome (DGS)/velocardiofacial syndrome (VCFS), a common congenital disorder characterized by neural-crest-related developmental defects, has been associated with deletions of chromosome 22q11.2, where this gene has been mapped. Studies using mouse models of DiGeorge syndrome suggest a major role for this gene in the molecular etiology of DGS/VCFS. Several alternatively spliced transcript variants encoding different isoforms have been described for this gene. [provided by RefSeq, July 2008]. Transcript Variant: This variant (A) contains an alternate exon 9 compared to variant C, resulting in an isoform (A) with the same N-terminal 336 aa, but an unique C-terminus with respect to isoforms B and C. This gene is a member of a phylogenetically conserved family of genes that share a common DNA-binding domain, the T-box. T-box genes encode transcription factors involved in the regulation of developmental processes. This gene product shares 98% amino acid sequence identity with the mouse ortholog. DiGeorge syndrome (DGS)/velocardiofacial syndrome (VCFS), a common congenital disorder characterized by neural-crest-related developmental defects, has been associated with deletions of chromosome 22q11.2, where this gene has been mapped. Studies using mouse models of DiGeorge syndrome suggest a major role for this gene in the molecular etiology of DGS/VCFS. Several alternatively spliced transcript variants encoding different isoforms have been described for this gene. [provided by RefSeq, July 2008]. Transcript Variant: This variant (C) encodes the longest isoform (C) with the same N-terminal 336 aa, but an unique C-terminus with respect to isoforms A and B. |
| TRMT2A | Y | 1073 | NM_022727 | *Homo sapiens* TRM2 tRNA methyltransferase 2 homolog A (*S. cerevisiae*) (TRMT2A), transcript variant 1, mRNA. | N/A |
| TRMT2A | Y | 1074 | NM_182984 | *Homo sapiens* TRM2 tRNA methyltransferase 2 homolog A (*S. cerevisiae*) (TRMT2A), transcript variant 2, mRNA. | N/A |
| TSSK2 | Y | 1075 | NM_053006 | *Homo sapiens* testis-specific serine kinase 2 (TSSK2), mRNA. | TSSK2 belongs to a family of serine/threonine kinases highly expressed in testis (Hao et al., 2004 [PubMed 15044604]). [supplied by OMIM, March 2008]. |
| TXNRD2 | Y | 1076 | NM_006440 | *Homo sapiens* thioredoxin reductase 2 (TXNRD2), nuclear gene encoding mitochondrial protein, mRNA. | Thioredoxin reductase (TR) is a dimeric NADPH-dependent FAD containing enzyme that catalyzes the reduction of the active site disulfide of thioredoxin and other substrates. TR is a member of a family of pyridine nucleotide-disulfide oxidoreductases and is a key enzyme in the regulation of the intracellular redox environment. Three thioredoxin reductase genes have been found that encode selenocysteine containing proteins. This gene partially overlaps the COMT gene on chromosome 22. [provided by RefSeq, July 2008]. |
| UFD1L | Y | 1077 | NM_001035247 | *Homo sapiens* ubiquitin fusion degradation 1 like (yeast) (UFD1L), transcript variant 2, mRNA. | The protein encoded by this gene forms a complex with two other proteins, nuclear protein localization-4 and valosin-containing protein, and this complex is necessary for the degradation of ubiquitinated proteins. In addition, this complex controls the disassembly of the mitotic spindle and the formation of a closed nuclear envelope after mitosis. Mutations in this gene have been associated with Catch 22 syndrome as well as cardiac and craniofacial defects. Alternative splicing results in multiple transcript variants encoding different isoforms. A related pseudogene has been identified on chromosome 18. [provided by RefSeq, June 2009]. Transcript Variant: This variant (2) uses an alternate splice site in the 3' coding region that results in a frameshift, compared to variant 1. The encoded isoform (B) has a distinct C-terminus and is shorter than isoform A. |

TABLE 4-continued

| Gene name | Exon overlap | SEQ ID No | RefSeq Accession Number | mRNA Description | RefSeq Summary |
|---|---|---|---|---|---|
| UFD1L | Y | 1078 | NM_005659 | *Homo sapiens* ubiquitin fusion degradation 1 like (yeast) (UFD1L), transcript variant 1, mRNA. | The protein encoded by this gene forms a complex with two other proteins, nuclear protein localization-4 and valosin-containing protein, and this complex is necessary for the degradation of ubiquitinated proteins. In addition, this complex controls the disassembly of the mitotic spindle and the formation of a closed nuclear envelope after mitosis. Mutations in this gene have been associated with Catch 22 syndrome as well as cardiac and craniofacial defects. Alternative splicing results in multiple transcript variants encoding different isoforms. A related pseudogene has been identified on chromosome 18. [provided by RefSeq, June 2009]. Transcript Variant: This variant (1) represents the longer transcript and encodes the longer isoform (A). |
| WLS | N | 1079 | NM_001002292 | *Homo sapiens* wntless homolog (*Drosophila*) (WLS), transcript variant 2, mRNA. | N/A |
| WLS | N | 1080 | NM_001193334 | *Homo sapiens* wntless homolog (*Drosophila*) (WLS), transcript variant 3, mRNA. | N/A |
| WLS | N | 1081 | NM_024911 | *Homo sapiens* wntless homolog (*Drosophila*) (WLS), transcript variant 1, mRNA. | N/A |
| FCGR1A | Y | 1082 | NM_000566 | *Homo sapiens* Fc fragment of IgG, high affinity Ia, receptor (CD64) (FCGR1A), mRNA. | This gene encodes a protein that plays an important role in the immune response. This protein is a high-affinity Fc-gamma receptor. The gene is one of three related gene family members located on chromosome 1. [provided by RefSeq, July 2008]. |
| FCGR1C | Y | 1083 | NR_027484 | *Homo sapiens* Fc fragment of IgG, high affinity Ic, receptor (CD64), pseudogene (FCGR1C), non-coding RNA. | The gene represents one of three related immunoglobulin gamma Fc receptor genes located on chromosome 1. This family member lacks the transmembrane and coiled-coiled domains found in other family members and is thought to be a pseudogene of Fc-gamma-receptor 1A. [provided by RefSeq, April 2009]. Sequence Note: The RefSeq transcript was derived from the reference genome assembly. The genomic coordinates were determined from alignments. |
| HIST2H2AA3 | Y | 1084 | NM_003516 | *Homo sapiens* histone cluster 2, H2aa3 (HIST2H2AA3), mRNA. | Histones are basic nuclear proteins that are responsible for the nucleosome structure of the chromosomal fiber in eukaryotes. Two molecules of each of the four core histones (H2A, H2B, H3, and H4) form an octamer, around which approximately 146 bp of DNA is wrapped in repeating units, called nucleosomes. The linker histone, H1, interacts with linker DNA between nucleosomes and functions in the compaction of chromatin into higher order structures. This gene is intronless and encodes a member of the histone H2A family. Transcripts from this gene lack polyA tails but instead contain a palindromic termination element. This gene is found in a histone cluster on chromosome 1. This gene is one of four histone genes in the cluster that are duplicated; this record represents the centromeric copy. [provided by RefSeq, July 2008]. |
| HIST2H2AA4 | Y | 1085 | NM_001040874 | *Homo sapiens* histone cluster 2, H2aa4 (HIST2H2AA4), mRNA. | Histones are basic nuclear proteins that are responsible for the nucleosome structure of the chromosomal fiber in eukaryotes. Two molecules of each of the four core histones (H2A, H2B, H3, and H4) form an octamer, around which approximately 146 bp of DNA is wrapped in repeating units, called nucleosomes. The linker histone, H1, interacts with linker DNA between nucleosomes and encodes in the compaction of chromatin into higher order structures. This gene is intronless and encodes a member of the histone H2A family. Transcripts from this gene lack polyA tails but instead contain a palindromic termination element. This gene is found in a histone cluster on chromosome 1. This gene is one of four histone genes in the cluster that are duplicated; this record represents the telomeric copy. [provided by RefSeq, July 2008]. Sequence Note: The RefSeq transcript was derived from the reference genome assembly. The genomic coordinates used for the transcript record were based on transcript alignments. |

TABLE 4-continued

| Gene name | Exon overlap | SEQ ID No | RefSeq Accession Number | mRNA Description | RefSeq Summary |
|---|---|---|---|---|---|
| HIST2H2BF | Y | 1086 | NM_001024599 | *Homo sapiens* histone cluster 2, H2bf (HIST2H2BF), transcript variant 1, mRNA. | N/A |
| HIST2H2BF | Y | 1087 | NM_001161334 | *Homo sapiens* histone cluster 2, H2bf (HIST2H2BF), transcript variant 2, mRNA. | N/A |
| HIST2H3A | Y | 1088 | NM_001005464 | *Homo sapiens* histone cluster 2, H3a (HIST2H3A), mRNA. | Histones are basic nuclear proteins that are responsible for the nucleosome structure of the chromosomal fiber in eukaryotes. This structure consists of approximately 146 bp of DNA wrapped around a nucleosome, an octamer composed of pairs of each of the four core histones (H2A, H2B, H3, and H4). The chromatin fiber is further compacted through the interaction of a linker histone, H1, with the DNA between the nucleosomes to form higher order chromatin structures. This gene is intronless and encodes a member of the histone H3 family. Transcripts from this gene lack polyA tails; instead, they contain a palindromic termination element. This gene is found in a histone cluster on chromosome 1. This gene is one of four histone genes in the cluster that are duplicated; this record represents the centromeric copy. [provided by RefSeq, July 2008]. |
| HIST2H3C | Y | 1089 | NM_021059 | *Homo sapiens* histone cluster 2, H3b (HIST2H3C), mRNA. | Histones are basic nuclear proteins that are responsible for the nucleosome structure of the chromosomal fiber in eukaryotes. This structure consists of approximately 146 bp of DNA wrapped around a nucleosome, an octamer composed of pairs of each of the four core histones (H2A, H2B, H3, and H4). The chromatin fiber is further compacted through the interaction of a linker histone, H1, with the DNA between the nucleosomes to form higher order chromatin structures. This gene is intronless and encodes a member of the histone H3 family. Transcripts from this gene lack polyA tails; instead, they contain a palindromic termination element. This gene is found in a histone cluster on chromosome 1. This gene is one of four histone genes in the cluster that are duplicated; this record represents the telomeric copy. [provided by RefSeq, July 2008]. |
| HIST2H3D | Y | 1090 | NM_001123375 | *Homo sapiens* histone cluster 2, H3d (HIST2H3D), mRNA. | N/A |
| HIST2H4A | Y | 1091 | NM_003548 | *Homo sapiens* histone cluster 2, H4a (HIST2H4A), mRNA. | Histones are basic nuclear proteins that are responsible for the nucleosome structure of the chromosomal fiber in eukaryotes. This structure consists of approximately 146 bp of DNA wrapped around a nucleosome, an octamer composed of pairs of each of the four core histones (H2A, H2B, H3, and H4). The chromatin fiber is further compacted through the interaction of a linker histone, H1, with the DNA between the nucleosomes to form higher order chromatin structures. This gene is intronless and encodes a member of the histone H4 family. Transcripts from this gene lack polyA tails; instead, they contain a palindromic termination element. This gene is found in a histone cluster on chromosome 1. This gene is one of four histone genes in the cluster that are duplicated; this record represents the centromeric copy. [provided by RefSeq, July 2008]. |
| HIST2H4B | Y | 1092 | NM_001034077 | *Homo sapiens* histone cluster 2, H4b (HIST2H4B), mRNA. | Histones are basic nuclear proteins that are responsible for the nucleosome structure of the chromosomal fiber in eukaryotes. This structure consists of approximately 146 bp of DNA wrapped around a nucleosome, an octamer composed of pairs of each of the four core histones (H2A, H2B, H3, and H4). The chromatin fiber is further compacted through the interaction of a linker histone, H1, with the DNA between the nucleosomes to form higher order chromatin structures. This gene is intronless and encodes a member of the histone H4 family. Transcripts from this gene lack polyA tails; instead, they contain a palindromic termination element. This gene is found in a histone cluster on chromosome 1. This gene is one of four histone genes in the cluster that are duplicated; this record represents the telomeric copy. [provided by RefSeq, July 2008]. |

TABLE 4-continued

| Gene name | Exon overlap | SEQ ID No | RefSeq Accession Number | mRNA Description | RefSeq Summary |
|---|---|---|---|---|---|
| LOC728855 | Y | 1093 | NR_024510 | *Homo sapiens* uncharacterized LOC728855 (LOC728855), non-coding RNA. | N/A |
| LOC728855 | Y | 1094 | NR_024511 | *Homo sapiens* uncharacterized LOC728855 (LOC728855), non-coding RNA. | N/A |
| PPIA4A | Y | 1095 | NM_178230 | *Homo sapiens* peptidylprolyl isomerase A (cyclophilin A)-like 4A (PPIAL4A), mRNA. | N/A |
| PPIA4C | Y | 1096 | NM_001135789 | *Homo sapiens* peptidylprolyl isomerase A (cyclophilin A)-like 4C (PPIAL4C), mRNA. | N/A |
| LCE3D | Y | 1097 | NM_032563 | *Homo sapiens* late cornified envelope 3D (LCE3D), mRNA. | N/A |
| LCE3E | Y | 1098 | NM_178435 | *Homo sapiens* late cornified envelope 3E (LCE3E), mRNA. | N/A |
| ZBBX | N | 1099 | NM_001199201 | *Homo sapiens* zinc finger, B-box domain containing (ZBBX), transcript variant 1, mRNA. | N/A |
| ZBBX | N | 1100 | NM_001199202 | *Homo sapiens* zinc finger, B-box domain containing (ZBBX), transcript variant 3, mRNA. | N/A |
| ZBBX | N | 1101 | NM_024687 | *Homo sapiens* zinc finger, B-box domain containing (ZBBX), transcript variant 2, mRNA. | N/A |
| PCDHB16 | Y | 1102 | NM_0290957 | *Homo sapiens* protocadherin beta 16 (PCDHB16), mRNA. | This gene is a member of the protocadherin beta gene cluster, one of three related gene clusters tandemly linked on chromosome five. The gene clusters demonstrate an unusual genomic organization similar to that of B-cell and T-cell receptor gene clusters. The beta cluster contains 16 genes and 3 pseudogenes, each encoding 6 extracellular cadherin domains and a cytoplasmic tail that deviates from others in the cadherin superfamily. The extracellular domains interact in a homophilic manner to specify differential cell-cell connections. Unlike the alpha and gamma clusters, the transcripts from these genes are made up of only one large exon, not sharing common 3' exons as expected. These neural cadherin-like cell adhesion proteins are integral plasma membrane proteins. Their specific functions are unknown but they most likely play a critical role in the establishment and function of specific cell-cell neural connections. [provided by RefSeq, July 2008]. |
| PCDHB8 | Y | 1103 | NM_019120 | *Homo sapiens* protocadherin beta 8 (PCDHB8), mRNA. | This gene is a member of the protocadherin beta gene cluster, one of three related gene clusters tandemly linked on chromosome five. The gene clusters demonstrate an unusual genomic organization similar to that of B-cell and T-cell receptor gene clusters. The beta cluster contains 16 genes and 3 pseudogenes, each encoding 6 extracellular cadherin domains and a cytoplasmic tail that deviates from others in the cadherin superfamily. The extracellular domains interact in a homophilic manner to |

TABLE 4-continued

| Gene name | SEQ ID No | RefSeq Accession Number | mRNA Description | RefSeq Summary |
|---|---|---|---|---|
| | | | | specify differential cell-cell connections. Unlike the alpha and gamma clusters, the transcripts from these genes are made up of only one large exon, not sharing common 3' exons as expected. These neural cadherin-like cell adhesion proteins are integral plasma membrane proteins. Their specific functions are unknown but they most likely play a critical role in the establishment and function of specific cell-cell neural connections. [provided by RefSeq, July 2008]. |
| ATRNL1 | 1104 | NM_207303 | *Homo sapiens* attractin-like 1 (ATRNL1), mRNA. | N/A |
| ZAN | 1105 | NM_003386 | *Homo sapiens* zonadhesin (ZAN), transcript variant 3, mRNA. | This gene encodes a sperm membrane protein that binds the zona pellucida of the egg in a species-specific manner. The encoded protein may be involved in signaling or gamete recognition. Alternate transcriptional splice variants, encoding different isoforms, have been characterized. [provided by RefSeq, July 2008]. Transcript Variant: This variant (3) represents the longer transcript and encodes the longer isoform (3). |
| ZAN | 1106 | NM_173059 | *Homo sapiens* zonadhesin (ZAN), transcript variant 6, mRNA. | This gene encodes a sperm membrane protein that binds the zona pellucida of the egg in a species-specific manner. The encoded protein may be involved in signaling or gamete recognition. Alternate transcriptional splice variants, encoding different isoforms, have been characterized. [provided by RefSeq, July 2008]. Transcript Variant: This variant (6) has multiple differences in the coding region but maintains the reading frame, compared to variant 3. This variant encodes isoform 6 which is 91 aa shorter than isoform 3. |
| WWOX | 1107 | NM_016373 | *Homo sapiens* WW domain containing oxidoreductase (WWOX), transcript variant 1, mRNA. | WW domain-containing proteins are found in all eukaryotes and play an important role in the regulation of a wide variety of cellular functions such as protein degradation, transcription, and RNA splicing. This gene encodes a protein which contains 2 WW domains and a short-chain dehydrogenase/reductase domain (SRD). The highest normal expression of this gene is detected in hormonally regulated tissues such as testis, ovary, and prostate. This expression pattern and the presence of an SRD domain suggest a role for this gene in steroid metabolism. The encoded protein is more than 90% identical to the mouse protein, which is an essential mediator of tumor necrosis factor-alpha-induced apoptosis, suggesting a similar, important role in apoptosis for the human protein. In addition, there is evidence that this gene behaves as a suppressor of tumor growth. Alternative splicing of this gene generates transcript variants that encode different isoforms. [provided by RefSeq, July 2008]. Transcript Variant: This variant (1) encodes the longest isoform. |
| WWOX | 1108 | NM_130791 | *Homo sapiens* WW domain containing oxidoreductase (WWOX), transcript variant 2, mRNA. | WW domain-containing proteins are found in all eukaryotes and play an important role in the regulation of a wide variety of cellular functions such as protein degradation, transcription, and RNA splicing. This gene encodes a protein which contains 2 WW domains and a short-chain dehydrogenase/reductase domain (SRD). The highest normal expression of this gene is detected in hormonally regulated tissues such as testis, ovary, and prostate. This expression pattern and the presence of an SRD domain suggest a role for this gene in steroid metabolism. The encoded protein is more than 90% identical to the mouse protein, which is an essential mediator of tumor necrosis factor-alpha-induced apoptosis, suggesting a similar, important role in apoptosis for the human protein. In addition, there is evidence that this gene behaves as a suppressor of tumor growth. Alternative splicing of this gene generates transcript variants that encode different isoforms. [provided by RefSeq, July 2008]. Transcript Variant: This variant (2) is much shorter and has an alternate 3' end, as compared to variant 1. It encodes a shorter isoform (2) which contains a partial sequence of the SRD region and has a different C-terminus from that of isoform 1. Publication Note: This RefSeq record includes a subset of the publications that are available for this gene. Please see the Gene record to access additional publications. |
| WWOX | 1109 | NM_130844 | *Homo sapiens* WW domain containing oxidoreductase (WWOX), transcript variant 3, mRNA. | WW domain-containing proteins are found in all eukaryotes and play an important role in the regulation of a wide variety of cellular functions such as protein degradation, transcription, and RNA splicing. This gene encodes a protein which contains 2 WW domains and a short-chain dehydrogenase/reductase domain (SRD). The highest normal expression of this gene is detected in hormonally regulated tissues such as testis, ovary, and prostate. This expression pattern and the |

Exon overlap column: ATRNL1: N; ZAN (1105): Y; ZAN (1106): Y; WWOX (1107): N; WWOX (1108): N; WWOX (1109): N.

TABLE 4-continued

| Gene name | Exon overlap | SEQ ID No | RefSeq Accession Number | mRNA Description | RefSeq Summary |
|---|---|---|---|---|---|
| | | | | | presence of an SRD domain suggest a role for this gene in steroid metabolism. The encoded protein is more than 90% identical to the mouse protein, which is an essential mediator of tumor necrosis factor-alpha-induced apoptosis, suggesting a similar, important role in apoptosis for the human protein. In addition, there is evidence that this gene behaves as a suppressor of tumor growth. Alternative splicing of this gene generates transcript variants that encode different isoforms. [provided by RefSeq, July 2008]. Transcript Variant: This variant (3) has a much shorter and alternate 3' end, as compared to variant 1. It encodes the shortest isoform (3) which contains only part of the first WW domain and lacks the second WW domain and the SRD region. |
| CLEC3A | Y | 1110 | NM_001244755 | *Homo sapiens* C-type lectin domain family 3, member A (CLEC3A), transcript variant 2, mRNA. | N/A |
| CLEC3A | Y | 1111 | NM_005752 | *Homo sapiens* C-type lectin domain family 3, member A (CLEC3A), transcript variant 1, mRNA. | N/A |
| ANKRD44 | both | 1112 | NM_001195144 | *Homo sapiens* ankyrin repeat domain 44 (ANKRD44), transcript variant A, mRNA. | N/A |
| ANKRD44 | both | 1113 | NM_153697 | *Homo sapiens* ankyrin repeat domain 44 (ANKRD44), transcript variant B, mRNA. | N/A |
| LOC653513 | Y | 1114 | NR_037182 | *Homo sapiens* phosphodiesterase 4D interacting protein pseudogene (LOC653513), non-coding RNA. | N/A |
| LOC728875 | Y | 1115 | NR_024584 | *Homo sapiens* uncharacterized LOC728875 (LOC728875), non-coding RNA. | N/A |
| NBPF9 | Y | 1116 | NM_001037675 | *Homo sapiens* neuroblastoma breakpoint family, member 9 (NBPF9), mRNA. | N/A |
| PDE4DIP | Y | 1117 | NM_001002810 | *Homo sapiens* phosphodiesterase 4D interacting protein (PDE4DIP), transcript variant 4, mRNA. | The protein encoded by this gene serves to anchor phosphodiesterase 4D to the Golgi/centrosome region of the cell. Defects in this gene may be a cause of myeloproliferative disorder (MBD) associated with eosinophilia. Several transcript variants encoding different isoforms have been found for this gene. [provided by RefSeq, August 2010]. Transcript Variant: This variant (4) lacks multiple 3' exons but has an alternate 3' sequence compared to variant 1. The resulting isoform (4) is C-terminal truncated compared to isoform 1. Sequence Note: This RefSeq record was created from transcript and genomic sequence data to make the sequence consistent with the reference genome assembly. The genomic coordinates used for the transcript record were based on transcript alignments. |

TABLE 4-continued

| Gene name | Exon overlap | SEQ ID No | RefSeq Accession Number | mRNA Description | RefSeq Summary |
|---|---|---|---|---|---|
| PDE4DIP | Y | 1118 | NM_001002811 | Homo sapiens phosphodiesterase 4D interacting protein (PDE4DIP), transcript variant 5, mRNA. | The protein encoded by this gene serves to anchor phosphodiesterase 4D to the Golgi/centrosome region of the cell. Defects in this gene may be a cause of myeloproliferative disorder (MBD) associated with eosinophilia. Several transcript variants encoding different isoforms have been found for this gene. [provided by RefSeq, August 2010]. Transcript Variant: This variant (5) lacks multiple 5' and 3' exons but has alternate 5' and 3' sequences compared to variant 1. The resulting isoform (5) has a shorter and distinct N-terminus and is C-terminal truncated compared to isoform 1. |
| PDE4DIP | Y | 1119 | NM_001002812 | Homo sapiens phosphodiesterase 4D interacting protein (PDE4DIP), transcript variant 2, mRNA. | The protein encoded by this gene serves to anchor phosphodiesterase 4D to the Golgi/centrosome region of the cell. Defects in this gene may be a cause of myeloproliferative disorder (MBD) associated with eosinophilia. Several transcript variants encoding different isoforms have been found for this gene. [provided by RefSeq, August 2010]. Transcript Variant: This variant (2) lacks multiple 3' exons and has an alternate 3' exon compared to variant 1. The resulting isoform (2) is C-terminal truncated compared to isoform 1. |
| PDE4DIP | Y | 1120 | NM_001195260 | Homo sapiens phosphodiesterase 4D interacting protein (PDE4DIP), transcript variant 6, mRNA. | The protein encoded by this gene serves to anchor phosphodiesterase 4D to the Golgi/centrosome region of the cell. Defects in this gene may be a cause of myeloproliferative disorder (MBD) associated with eosinophilia. Several transcript variants encoding different isoforms have been found for this gene. [provided by RefSeq, August 2010]. Transcript Variant: This variant (6) differs in both UTRs and in the coding sequence compared to variant 1. The resulting isoform (6) is shorter at the N- and C-termini compared to isoform 1. Sequence Note: This RefSeq record was created from transcript and genomic sequence data to make the sequence consistent with the reference genome assembly. The genomic coordinates used for the transcript record were based on transcript alignments. |
| PDE4DIP | Y | 1121 | NM_001195261 | Homo sapiens phosphodiesterase 4D interacting protein (PDE4DIP), transcript variant 7, mRNA. | The protein encoded by this gene serves to anchor phosphodiesterase 4D to the Golgi/centrosome region of the cell. Defects in this gene may be a cause of myeloproliferative disorder (MBD) associated with eosinophilia. Several transcript variants encoding different isoforms have been found for this gene. [provided by RefSeq, August 2010]. Transcript Variant: This variant (7) differs in both UTRs and in the coding sequence compared to variant 1. The resulting isoform (7) has a longer and distinct N-terminus and a shorter C-terminus compared to isoform 1. Sequence Note: This RefSeq record was created from transcript and genomic sequence data to make the sequence consistent with the reference genome assembly. The genomic coordinates used for the transcript record were based on transcript alignments. |
| PDE4DIP | Y | 1122 | NM_001198832 | Homo sapiens phosphodiesterase 4D interacting protein (PDE4DIP), transcript variant 8, mRNA. | The protein encoded by this gene serves to anchor phosphodiesterase 4D to the Golgi/centrosome region of the cell. Defects in this gene may be a cause of myeloproliferative disorder (MBD) associated with eosinophilia. Several transcript variants encoding different isoforms have been found for this gene. [provided by RefSeq, August 2010]. Transcript Variant: This variant (8) differs in the 5' UTR and CDS compared to variant 1. The resulting isoform (8) has a longer and distinct N-terminus and lacks two internal segments compared to isoform (1). Sequence Note: This RefSeq record was created from transcript and genomic sequence data to make the sequence consistent with the reference genome assembly. The genomic coordinates used for the transcript record were based on transcript alignments. |
| PDE4DIP | Y | 1123 | NM_001198834 | Homo sapiens phosphodiesterase 4D interacting protein (PDE4DIP), transcript variant 9, mRNA. | The protein encoded by this gene serves to anchor phosphodiesterase 4D to the Golgi/centrosome region of the cell. Defects in this gene may be a cause of myeloproliferative disorder (MBD) associated with eosinophilia. Several transcript variants encoding different isoforms have been found for this gene. [provided by RefSeq, August 2010]. Transcript Variant: This variant (9) has an alternate splice site in the last splice junction compared to variant 1. The resulting isoform (9) has a longer and distinct C-terminus compared to isoform 1. Sequence Note: This RefSeq record was created from transcript and genomic sequence data to make the sequence consistent with the reference genome assembly. The genomic coordinates used for the transcript record were based on transcript alignments. |
| PDE4DIP | Y | 1124 | NM_014644 | Homo sapiens phosphodiesterase 4D interacting protein | The protein encoded by this gene serves to anchor phosphodiesterase 4D to the Golgi/centrosome region of the cell. Defects in this gene may be a cause of myeloproliferative disorder (MBD) associated with eosinophilia. Several transcript variants encoding different isoforms have been found |

TABLE 4-continued

| Gene name | Exon overlap | SEQ ID No | RefSeq Accession Number | mRNA Description | RefSeq Summary |
|---|---|---|---|---|---|
| | | | | (PDE4DIP), transcript variant 1, mRNA. | for this gene. [provided by RefSeq, August 2010]. Transcript Variant: This variant (1) represents the longest transcript and encodes isoform 1. Sequence Note: The RefSeq transcript and protein were derived from genomic sequence to make the sequence consistent with the reference genome assembly. The genomic coordinates used for the transcript record were based on alignments. |
| PDE4DIP | Y | 1125 | NM_022359 | Homo sapiens phosphodiesterase 4D interacting protein (PDE4DIP), transcript variant 3, mRNA. | The protein encoded by this gene serves to anchor phosphodiesterase 4D to the Golgi/centrosome region of the cell. Defects in this gene may be a cause of myeloproliferative disorder (MBD) associated with eosinophilia. Several transcript variants encoding different isoforms have been found for this gene. [provided by RefSeq, August 2010]. Transcript Variant: This variant (3) has alternate 5' and 3' sequences and lacks multiple 3' exons compared to variant 1. The resulting isoform (3) has a longer and distinct N-terminus and a truncated C-terminus compared to isoform 1. Sequence Note: This RefSeq record was created from transcript and genomic sequence data to make the sequence consistent with the reference genome assembly. The genomic coordinates used for the transcript record were based on transcript alignments. |
| PPIAL4B | Y | 1126 | NM_001143883 | Homo sapiens peptidylprolyl isomerase A (cyclophilin A)-like 4B (PPIAL4B), mRNA. | N/A |
| SEC22B | Y | 1127 | NM_004892 | Homo sapiens SEC22 vesicle trafficking protein homolog B (S. cerevisiae) (gene/pseudogene) (SEC22B), mRNA. | The protein encoded by this gene is a member of the SEC22 family of vesicle trafficking proteins. It seems to complex with SNARE and it is thought to play a role in the ER-Golgi protein trafficking. This protein has strong similarity to Mus musculus and Cricetulus griseus proteins. [provided by RefSeq, September 2009]. |
| SRGAP2P2 | Y | 1128 | NR_034178 | Homo sapiens SLIT-ROBO Rho GTPase activating protein 2 pseudogene 2 (SRGAP2P2), non-coding RNA. | N/A |
| CROCC | Y | 1129 | NM_014675 | Homo sapiens ciliary rootlet coiled-coil, rootletin (CROCC), mRNA. | N/A |
| LOC150776 | Y | 1130 | NR_026922 | Homo sapiens sphingomyelin phosphodiesterase 4, neutral membrane pseudogene (LOC150776), non-coding RNA. | N/A |
| MZT2A | Y | 1131 | NM_001085365 | Homo sapiens mitotic spindle organizing protein 2A (MZT2A), mRNA. | N/A |
| TUBA3D | Y | 1132 | NM_080386 | Homo sapiens tubulin, alpha 3d (TUBA3D), mRNA. | This gene encodes a member of the alpha tubulin family. Tubulin is a major component of microtubules, which are composed of alpha- and beta-tubulin heterodimers and microtubule-associated proteins in the cytoskeleton. Microtubules maintain cellular structure, function in intracellular transport, and play a role in spindle formation during mitosis. [provided by RefSeq, October 2011]. |
| LSAMP | N | 1133 | NM_002338 | Homo sapiens limbic system-associated membrane protein (LSAMP), mRNA. | The protein encoded by this gene is a neuronal surface glycoprotein found in cortical and subcortical regions of the limbic system. During development of the limbic system, this encoded protein is found on the surface of axonal membranes and growth cones, where it acts as a selective homophilic adhesion molecule, and guides the development of specific patterns of neuronal connections. [provided by RefSeq, July 2008]. Sequence Note: This RefSeq record was created from transcript and genomic |

TABLE 4-continued

| Gene name | Exon overlap | SEQ ID No | RefSeq Accession Number | mRNA Description | RefSeq Summary |
|---|---|---|---|---|---|
| GLRA3 | N | 1134 | NM_001042543 | *Homo sapiens* glycine receptor, alpha 3 (GLRA3), transcript variant 2, mRNA. | sequence data to make the sequence consistent with the reference genome assembly. The genomic coordinates used for the transcript record were based on transcript alignments. The GLRA3 gene encodes the alpha-3 subunit of the neuronal glycine receptor, a ligand-gated chloride channel composed of ligand-binding alpha and structural beta polypeptides (Kingsmore et al., 1994 [PubMed 7894176]). [supplied by OMIM, November 2009]. |
| GLRA3 | N | 1135 | NM_006529 | *Homo sapiens* glycine receptor, alpha 3 (GLRA3), transcript variant 1, mRNA. | The GLRA3 gene encodes the alpha-3 subunit of the neuronal glycine receptor, a ligand-gated chloride channel composed of ligand-binding alpha and structural beta polypeptides (Kingsmore et al., 1994 [PubMed 7894176]). [supplied by OMIM, November 2009]. |
| ADAM5P | Y | 1136 | NR_001448 | *Homo sapiens* ADAM metallopeptidase domain 5, pseudogene (ADAM5P), non-coding RNA. | N/A |
| DCLRE1C | Y | 1137 | NM_001033855 | *Homo sapiens* DNA cross-link repair 1C (DCLRE1C), transcript variant a, mRNA. | This gene encodes a nuclear protein that is involved in V(D)J recombination and DNA repair. The protein has single-strand-specific 5'-3' exonuclease activity; it also exhibits endonuclease activity on 5' and 3' overhangs and hairpins when complexed with protein kinase, DNA-activated, catalytic polypeptide. Mutations in this gene cause Athabascan-type severe combined immunodeficiency (SCIDA). [provided by RefSeq, July 2008]. Transcript Variant: This variant (a) encodes the longest isoform (a). |
| DCLRE1C | Y | 1138 | NM_001033857 | *Homo sapiens* DNA cross-link repair 1C (DCLRE1C), transcript variant d, mRNA. | This gene encodes a nuclear protein that is involved in V(D)J recombination and DNA repair. The protein has single-strand-specific 5'-3' exonuclease activity; it also exhibits endonuclease activity on 5' and 3' overhangs and hairpins when complexed with protein kinase, DNA-activated, catalytic polypeptide. Mutations in this gene cause Athabascan-type severe combined immunodeficiency (SCIDA). [provided by RefSeq, July 2008]. Transcript Variant: This variant (d), also called variant 1, includes an alternate exon in the 5' UTR resulting in use of a downstream in-frame start codon, compared to variant a. Variant d encodes isoform d which is shorter than isoform a. |
| DCLRE1C | Y | 1139 | NM_001033858 | *Homo sapiens* DNA cross-link repair 1C (DCLRE1C), transcript variant c, mRNA. | This gene encodes a nuclear protein that is involved in V(D)J recombination and DNA repair. The protein has single-strand-specific 5'-3' exonuclease activity; it also exhibits endonuclease activity on 5' and 3' overhangs and hairpins when complexed with protein kinase, DNA-activated, catalytic polypeptide. Mutations in this gene cause Athabascan-type severe combined immunodeficiency (SCIDA). [provided by RefSeq, July 2008]. Transcript Variant: This variant (c), also called variant 5, includes two alternate exons in the 5' UTR resulting in use of a downstream in-frame start codon, compared to variant a. Variant c encodes isoform c, which is shorter than isoform a. |
| DCLRE1C | Y | 1140 | NM_022487 | *Homo sapiens* DNA cross-link repair 1C (DCLRE1C), transcript variant b, mRNA. | This gene encodes a nuclear protein that is involved in V(D)J recombination and DNA repair. The protein has single-strand-specific 5'-3' exonuclease activity; it also exhibits endonuclease activity on 5' and 3' overhangs and hairpins when complexed with protein kinase, DNA-activated, catalytic polypeptide. Mutations in this gene cause Athabascan-type severe combined immunodeficiency (SCIDA). [provided by RefSeq, July 2008]. Transcript Variant: This variant (b), also called variant 3, lacks an exon in the 3' coding region, compared to variant a. It encodes isoform b which has a shorter and distinct N-terminus, compared to variant a. |
| MEIG1 | Y | 1141 | NM_001080836 | *Homo sapiens* meiosis expressed gene 1 homolog (mouse) (MEIG1), mRNA. | N/A |
| SORCS1 | N | 1142 | NM_001013031 | *Homo sapiens* sortilin-related VPS10 domain containing receptor 1 (SORCS1), transcript variant 2, mRNA. | This gene encodes one family member of vacuolar protein sorting 10 (VPS10) domain-containing receptor proteins. The VPS10 domain name comes from the yeast carboxypeptidase Y sorting receptor Vps10 protein. Members of this gene family are large with many exons but the CDS lengths are usually less than 3700 nt. Very large introns typically separate the exons encoding the VPS10 domain; the remaining exons are separated by much smaller-sized introns. Two of the five family members (sortilin and sortilin-related receptor) are synthesized as preproproteins; it is not yet known if this encoded protein is also a preproprotein. These genes are strongly expressed in the central nervous system. |

TABLE 4-continued

| Gene name | Exon overlap | SEQ ID No | RefSeq Accession Number | mRNA Description | RefSeq Summary |
|---|---|---|---|---|---|
| | | | | | Alternatively spliced transcript variants encoding different isoforms have been identified. [provided by RefSeq, July 2008]. Transcript Variant: This variant (2) encodes the longest isoform (b). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| SORCS1 | N | 1143 | NM_001206569 | *Homo sapiens* sortilin-related VPS10 domain containing receptor 1 (SORCS1), transcript variant 3, mRNA. | This gene encodes one family member of vacuolar protein sorting 10 (VPS10) domain-containing receptor proteins. The VPS10 domain name comes from the yeast carboxypeptidase Y sorting receptor Vps10 protein. Members of this gene family are large with many exons but the CDS lengths are usually less than 3700 nt. Very large introns typically separate the exons encoding the VPS10 domain; the remaining exons are separated by much smaller-sized introns. These genes are strongly expressed in the central nervous system. Two of the five family members (sortilin and sortilin-related receptor) are synthesized as preproproteins; it is not yet known if this encoded protein is also a preproprotein. Alternatively spliced transcript variants encoding different isoforms have been identified. [provided by RefSeq, July 2008]. Transcript Variant: This variant (3) differs in the 3' UTR and coding sequence compared to variant 2. The resulting isoform (c) has a shorter and distinct C-terminus compared to isoform b. Sequence Note: This RefSeq record was created from transcript and genomic sequence data to make the sequence consistent with the reference genome assembly. The genomic coordinates used for the transcript record were based on transcript alignments. |
| SORCS1 | N | 1144 | NM_001206570 | *Homo sapiens* sortilin-related VPS10 domain containing receptor 1 (SORCS1), transcript variant 4, mRNA. | This gene encodes one family member of vacuolar protein sorting 10 (VPS10) domain-containing receptor proteins. The VPS10 domain name comes from the yeast carboxypeptidase Y sorting receptor Vps10 protein. Members of this gene family are large with many exons but the CDS lengths are usually less than 3700 nt. Very large introns typically separate the exons encoding the VPS10 domain; the remaining exons are separated by much smaller-sized introns. These genes are strongly expressed in the central nervous system. Two of the five family members (sortilin and sortilin-related receptor) are synthesized as preproproteins; it is not yet known if this encoded protein is also a preproprotein. Alternatively spliced transcript variants encoding different isoforms have been identified. [provided by RefSeq, July 2008]. Transcript Variant: This variant (4) lacks an alternate exon compared to variant 2, that causes a frameshift. The resulting isoform (d) has a shorter and distinct C-terminus compared to isoform b. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| SORCS1 | N | 1145 | NM_001206571 | *Homo sapiens* sortilin-related VPS10 domain containing receptor 1 (SORCS1), transcript variant 5, mRNA. | This gene encodes one family member of vacuolar protein sorting 10 (VPS10) domain-containing receptor proteins. The VPS10 domain name comes from the yeast carboxypeptidase Y sorting receptor Vps10 protein. Members of this gene family are large with many exons but the CDS lengths are usually less than 3700 nt. Very large introns typically separate the exons encoding the VPS10 domain; the remaining exons are separated by much smaller-sized introns. These genes are strongly expressed in the central nervous system. Two of the five family members (sortilin and sortilin-related receptor) are synthesized as preproproteins; it is not yet known if this encoded protein is also a preproprotein. Alternatively spliced transcript variants encoding different isoforms have been identified. [provided by RefSeq, July 2008]. Transcript Variant: This variant (5) differs in the 3' UTR and coding sequence compared to variant 2. The resulting isoform (e) has a shorter and distinct C-terminus compared to isoform b. Sequence Note: This RefSeq record was created from transcript and genomic sequence data to make the sequence consistent with the reference genome assembly. The genomic coordinates used |

TABLE 4-continued

| Gene name | Exon overlap | SEQ ID No | RefSeq Accession Number | mRNA Description | RefSeq Summary |
|---|---|---|---|---|---|
| SORCS1 | N | 1146 | NM_001206572 | Homo sapiens sortilin-related VPS10 domain containing receptor 1 (SORCS1), transcript variant 6, mRNA. | for the transcript record were based on transcript alignments. Publication Note: This RefSeq record includes a subset of the publications that are available for this gene. Please see the Gene record to access additional publications. This gene encodes one family member of vacuolar protein sorting 10 (VPS10) domain-containing receptor proteins. The VPS10 domain name comes from the yeast carboxypeptidase Y sorting receptor Vps10 protein. Members of this gene family are large with many exons but the CDS lengths are usually less than 3700 nt. Very large introns typically separate the exons encoding the VPS10 domain; the remaining exons are separated by much smaller-sized introns. These genes are strongly expressed in the central nervous system. Two of the five family members (sortilin and sortilin-related receptor) are synthesized as preproproteins; it is not yet known if this encoded protein is also a preproprotein. Alternatively spliced transcript variants encoding different isoforms have been identified. [provided by RefSeq, July 2008]. Transcript Variant: This variant (6) differs in the 3' UTR and coding sequence compared to variant 2. The resulting isoform (f) has a shorter and distinct C-terminus compared to isoform b. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| SORCS1 | N | 1147 | NM_052918 | Homo sapiens sortilin-related VPS10 domain containing receptor 1 (SORCS1), transcript variant 1, mRNA. | This gene encodes one family member of vacuolar protein sorting 10 (VPS10) domain-containing receptor proteins. The VPS10 domain name comes from the yeast carboxypeptidase Y sorting receptor Vps10 protein. Members of this gene family are large with many exons but the CDS lengths are usually less than 3700 nt. Very large introns typically separate the exons encoding the VPS10 domain; the remaining exons are separated by much smaller-sized introns. These genes are strongly expressed in the central nervous system. Two of the five family members (sortilin and sortilin-related receptor) are synthesized as preproproteins; it is not yet known if this encoded protein is also a preproprotein. Alternatively spliced transcript variants encoding different isoforms have been identified. [provided by RefSeq, July 2008]. Transcript Variant: This variant (1) differs in the 3' UTR and coding sequence compared to variant 2. The resulting isoform (a) has a shorter and distinct C-terminus compared to isoform b. Sequence Note: This RefSeq record was created from transcript and genomic sequence data to make the sequence consistent with the reference genome assembly. The genomic coordinates used for the transcript record were based on transcript alignments. |
| CHPT1 | N | 1148 | NM_020244 | Homo sapiens choline phosphotransferase 1 (CHPT1), mRNA. | N/A |
| GOLGA8A | Y | 1149 | NM_181077 | Homo sapiens golgin A8 family, member A (GOLGA8A), transcript variant 1, mRNA. | The Golgi apparatus, which participates in glycosylation and transport of proteins and lipids in the secretory pathway, consists of a series of stacked, flattened membrane sacs referred to as cisternae. Interactions between the Golgi and microtubules are thought to be important for the reorganization of the Golgi after it fragments during mitosis. The golgins constitute a family of proteins which are localized to the Golgi. This gene encodes a golgin which structurally resembles its family member GOLGA2, suggesting that they may share a similar function. There are many similar copies of this gene on chromosome 15. Alternative splicing results in multiple transcript variants. [provided by RefSeq, March 2009]. Transcript Variant: This variant (1) represents the shorter transcript and encodes the functional protein. Sequence Note: The RefSeq transcript and protein were derived from genomic sequence to make the sequence consistent with the reference genome assembly. The genomic coordinates used for the transcript record were based on alignments. |
| GOLGA8A | Y | 1150 | NR_027409 | Homo sapiens golgin A8 family, member A (GOLGA8A), transcript variant 2, mRNA. | The Golgi apparatus, which participates in glycosylation and transport of proteins and lipids in the secretory pathway, consists of a series of stacked, flattened membrane sacs referred to as cisternae. Interactions between the Golgi and microtubules are thought to be important for the reorganization of the Golgi after it fragments during mitosis. The golgins constitute a family of proteins which are |

TABLE 4-continued

| Gene name | Exon overlap | SEQ ID No | RefSeq Accession Number | mRNA Description | RefSeq Summary |
|---|---|---|---|---|---|
| | | | | | localized to the Golgi. This gene encodes a golgin which structurally resembles its family member GOLGA2, suggesting that they may share a similar function. There are many similar copies of this gene on chromosome 15. Alternative splicing results in multiple transcript variants. [provided by RefSeq, March 2009]. Transcript Variant: This variant (2) represents use of an alternate upstream promoter, contains additional 5' exons, and retains an intron, compared to variant 1. This variant is represented as non-coding because the use of the 5'-most expected translational start codon renders the transcript a candidate for nonsense-mediated mRNA decay (NMD). Sequence Note: The RefSeq transcript was derived from the reference genome assembly. The genomic coordinates were determined from alignments. |
| MIR1233-1 | Y | 1151 | NR_036050 | *Homo sapiens* microRNA 1223-1 (MIR1233-1), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MIR1233-2 | Y | 1152 | NR_036261 | *Homo sapiens* microRNA 1223-2 (MIR1233-2), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| ALDH1A2 | N | 1153 | NM_001206897 | *Homo sapiens* aldehyde dehydrogenase 1 family, member A2 (ALDH1A2), transcript variant 4, mRNA. | This protein belongs to the aldehyde dehydrogenase family of proteins. The product of this gene is an enzyme that catalyzes the synthesis of retinoic acid (RA) from retinaldehyde. Retinoic acid, the active derivative of vitamin A (retinol), is a hormonal signaling molecule that functions in developing and adult tissues. The studies of a similar mouse gene suggest that this enzyme and the cytochrome CYP26A1, concurrently establish local embryonic retinoic acid levels which facilitate posterior organ development and prevent spina bifida. Four transcript variants encoding distinct isoforms have been identified for this gene. [provided by RefSeq, May 2011]. Transcript Variant: This variant (4) differs in the 5' UTR and coding sequence compared to variant 1. The resulting isoform (4) has a shorter and distinct N-terminus compared to isoform 1. Sequence Note: removed 1 base from the 5' end that did not align to the reference genome assembly. Publication Note: This RefSeq record includes a subset of the publications that are available for this gene. Please see the Gene record to access additional publications. |
| ALDH1A2 | N | 1154 | NM_003888 | *Homo sapiens* aldehyde dehydrogenase 1 family, | This protein belongs to the aldehyde dehydrogenase family of proteins. The product of this gene is an enzyme that catalyzes the synthesis of retinoic acid (RA) from retinaldehyde. Retinoic acid, the active |

TABLE 4-continued

| Gene name | Exon overlap | SEQ ID No | RefSeq Accession Number | mRNA Description | RefSeq Summary |
|---|---|---|---|---|---|
| | | | | member A2 (ALDH1A2), transcript variant 1, mRNA. | derivative of vitamin A (retinol), is a hormonal signaling molecule that functions in developing and adult tissues. The studies of a similar mouse gene suggest that this enzyme and the cytochrome CYP26A1, concurrently establish local embryonic retinoic acid levels which facilitate posterior organ development and prevent spina bifida. Four transcript variants encoding distinct isoforms have been identified for this gene. [provided by RefSeq, May 2011]. Transcript Variant: This variant (1) represents the longest transcript and encodes the longest isoform (1). Publication Note: This RefSeq record includes a subset of the publications that are available for this gene. Please see the Gene record to access additional publications. |
| ALDH1A2 | N | 1155 | NM_170696 | Homo sapiens aldehyde dehydrogenase 1 family, member A2 (ALDH1A2), transcript variant 2, mRNA. | This protein belongs to the aldehyde dehydrogenase family of proteins. The product of this gene is an enzyme that catalyzes the synthesis of retinoic acid (RA) from retinaldehyde. Retinoic acid, the active derivative of vitamin A (retinol), is a hormonal signaling molecule that functions in developing and adult tissues. The studies of a similar mouse gene suggest that this enzyme and the cytochrome CYP26A1, concurrently establish local embryonic retinoic acid levels which facilitate posterior organ development and prevent spina bifida. Four transcript variants encoding distinct isoforms have been identified for this gene. [provided by RefSeq, May 2011]. Transcript Variant: This variant (2) lacks an alternate in-frame exon compared to variant 1. The resulting isoform (2) has the same N- and C-termini but is shorter compared to isoform 1. Sequence Note: removed 1 base from the 5' end that did not align to the reference genome assembly. Publication Note: This RefSeq record includes a subset of the publications that are available for this gene. Please see the Gene record to access additional publications. |
| ALDH1A2 | N | 1156 | NM_170697 | Homo sapiens aldehyde dehydrogenase 1 family, member A2 (ALDH1A2), transcript variant 3, mRNA. | This protein belongs to the aldehyde dehydrogenase family of proteins. The product of this gene is an enzyme that catalyzes the synthesis of retinoic acid (RA) from retinaldehyde. Retinoic acid, the active derivative of vitamin A (retinol), is a hormonal signaling molecule that functions in developing and adult tissues. The studies of a similar mouse gene suggest that this enzyme and the cytochrome CYP26A1, concurrently establish local embryonic retinoic acid levels which facilitate posterior organ development and prevent spina bifida. Four transcript variants encoding distinct isoforms have been identified for this gene. [provided by RefSeq, May 2011]. Transcript Variant: This variant (3) differs in the 5' UTR and coding sequence compared to variant 1. The resulting isoform (3) is shorter at the N-terminus compared to isoform 1. |
| HPR | Y | 1157 | NM_020995 | Homo sapiens haptoglobin-related protein (HPR), mRNA. | This gene encodes a haptoglobin-related protein that binds hemoglobin as efficiently as haptoglobin. Unlike haptoglobin, plasma concentration of this protein is unaffected in patients with sickle cell anemia and extensive intravascular hemolysis, suggesting a difference in binding between haptoglobin-hemoglobin and haptoglobin-related protein-hemoglobin complexes to CD163, the hemoglobin scavenger receptor. This protein may also be a clinically important predictor of recurrence of breast cancer. [provided by RefSeq, October 2011]. |
| ACACA | N | 1158 | NM_198834 | Homo sapiens acetyl-CoA carboxylase alpha (ACACA), transcript variant 1, mRNA. | Acetyl-CoA carboxylase (ACC) is a complex multifunctional enzyme system. ACC is a biotin-containing enzyme which catalyzes the carboxylation of acetyl-CoA to malonyl-CoA, the rate-limiting step in fatty acid synthesis. There are two ACC forms, alpha and beta, encoded by two different genes. ACC-alpha is highly enriched in lipogenic tissues. The enzyme is under long term control at the transcriptional and translational levels and under short term regulation by the phosphorylation/dephosphorylation of targeted serine residues and by allosteric transformation by citrate or palmitoyl-CoA. Multiple alternatively spliced transcript variants divergent in the 5' sequence and encoding distinct isoforms have been found for this gene. [provided by RefSeq, July 2008]. Transcript Variant: This variant (1) encodes the longest isoform (1). |
| ACACA | N | 1159 | NM_198836 | Homo sapiens acetyl-CoA carboxylase alpha (ACACA), transcript variant 3, mRNA. | Acetyl-CoA carboxylase (ACC) is a complex multifunctional enzyme system. ACC is a biotin-containing enzyme which catalyzes the carboxylation of acetyl-CoA to malonyl-CoA, the rate-limiting step in fatty acid synthesis. There are two ACC forms, alpha and beta, encoded by two different genes. ACC-alpha is highly enriched in lipogenic tissues. The enzyme is under long term control at the |

TABLE 4-continued

| Gene name | Exon overlap | SEQ ID No | RefSeq Accession Number | mRNA Description | RefSeq Summary |
|---|---|---|---|---|---|
| | | | | | phosphorylation/dephosphorylation of targeted serine residues and by allosteric transformation by citrate or palmitoyl-CoA. Multiple alternatively spliced transcript variants divergent in the 5' sequence and encoding distinct isoforms have been found for this gene. [provided by RefSeq, July 2008]. Transcript Variant: This variant (3) has an alternate 5' UTR exon, and uses a downstream start codon, as compared to variant (1). The resulting isoform (2) has a shorter N-terminus, as compared to isoform 1. |
| ACACA | N | 1160 | NM_198837 | Homo sapiens acetyl-CoA carboxylase alpha (ACACA), transcript variant 4, mRNA. | Acetyl-CoA carboxylase (ACC) is a complex multifunctional enzyme system. ACC is a biotin-containing enzyme which catalyzes the carboxylation of acetyl-CoA to malonyl-CoA, the rate-limiting step in fatty acid synthesis. There are two ACC forms, alpha and beta, encoded by two different genes. ACC-alpha is highly enriched in lipogenic tissues. The enzyme is under long term control at the transcriptional and translational levels and under short term regulation by the phosphorylation/dephosphorylation of targeted serine residues and by allosteric transformation by citrate or palmitoyl-CoA. Multiple alternatively spliced transcript variants divergent in the 5' sequence and encoding distinct isoforms have been found for this gene. [provided by RefSeq, July 2008]. Transcript Variant: This variant (4) has a shorter and alternate 5' sequence, as compared to variant 1. The resulting isoform (3) has a distinct and shorter N-terminus, as compared to isoform 1. |
| ACACA | N | 1161 | NM_198838 | Homo sapiens acetyl-CoA carboxylase alpha (ACACA), transcript variant 5, mRNA. | Acetyl-CoA carboxylase (ACC) is a complex multifunctional enzyme system. ACC is a biotin-containing enzyme which catalyzes the carboxylation of acetyl-CoA to malonyl-CoA, the rate-limiting step in fatty acid synthesis. There are two ACC forms, alpha and beta, encoded by two different genes. ACC-alpha is highly enriched in lipogenic tissues. The enzyme is under long term control at the transcriptional and translational levels and under short term regulation by the phosphorylation/dephosphorylation of targeted serine residues and by allosteric transformation by citrate or palmitoyl-CoA. Multiple alternatively spliced transcript variants divergent in the 5' sequence and encoding distinct isoforms have been found for this gene. [provided by RefSeq, July 2008]. Transcript Variant: This variant (5) has a shorter and alternate 5' sequence and uses a downstream start codon, as compared to variant 1. The resulting isoform (4) has a shorter N-terminus, as compared to isoform 1. |
| ACACA | N | 1162 | NM_198839 | Homo sapiens acetyl-CoA carboxylase alpha (ACACA), transcript variant 2, mRNA. | Acetyl-CoA carboxylase (ACC) is a complex multifunctional enzyme system. ACC is a biotin-containing enzyme which catalyzes the carboxylation of acetyl-CoA to malonyl-CoA, the rate-limiting step in fatty acid synthesis. There are two ACC forms, alpha and beta, encoded by two different genes. ACC-alpha is highly enriched in lipogenic tissues. The enzyme is under long term control at the transcriptional and translational levels and under short term regulation by the phosphorylation/dephosphorylation of targeted serine residues and by allosteric transformation by citrate or palmitoyl-CoA. Multiple alternatively spliced transcript variants divergent in the 5' sequence and encoding distinct isoforms have been found for this gene. [provided by RefSeq, July 2008]. Transcript Variant: This variant (2) is the longest transcript, which has several additional exons in the 5' region, as compared to variant 1. It uses a downstream start codon and the resulting isoform (2) has a shorter N-terminus, as compared to isoform 1. |
| MAGI3 | N | 1163 | NM_001142782 | Homo sapiens membrane associated guanylate kinase, WW and PDZ domain containing 3 (MAGI3), transcript variant 1, mRNA. | N/A |
| MAGI3 | N | 1164 | NM_152900 | Homo sapiens membrane associated guanylate kinase, WW and PDZ domain containing 3 (MAGI3), transcript variant 2, mRNA. | N/A |

TABLE 4-continued

| Gene name | Exon overlap | SEQ ID No | RefSeq Accession Number | mRNA Description | RefSeq Summary |
|---|---|---|---|---|---|
| ANAPC1 | Y | 1165 | NM_022662 | Homo sapiens anaphase promoting complex subunit 1 (ANAPC1), mRNA. | ANAPC1 is 1 of at least 10 subunits of the anaphase-promoting complex (APC), which functions at the metaphase-to-anaphase transition of the cell cycle and is regulated by spindle checkpoint proteins. The APC is an E3 ubiquitin ligase that targets cell cycle regulatory proteins for degradation by the proteasome, thereby allowing progression through the cell cycle. [supplied by OMIM, April 2004]. |
| LYPD6 | N | 1166 | NM_001195685 | Homo sapiens LY6/PLAUR domain containing 6 (LYPD6), transcript variant 1, mRNA. | Members of the LY6 protein family (see SLURP1; MIM 606119), such as LYPD6, have at least one 80-amino acid LU domain that contains 10 conserved cysteines with a defined disulfide-bonding pattern (Zhang et al., 2010 [PubMed 19653121]). [supplied by OMIM, April 2010]. Transcript Variant: This variant (1) represents the longer transcript. Variants 1 and 2 encode the same protein. |
| LYPD6 | N | 1167 | NM_194317 | Homo sapiens LY6/PLAUR domain containing 6 (LYPD6), transcript variant 2, mRNA. | Members of the LY6 protein family (see SLURP1; MIM 606119), such as LYPD6, have at least one 80-amino acid LU domain that contains 10 conserved cysteines with a defined disulfide-bonding pattern (Zhang et al., 2010 [PubMed 19653121]). [supplied by OMIM, April 2010]. Transcript Variant: This variant (2) uses a different segment for its 5' UTR, compared to variant 1. Variants 1 and 2 encode the same protein. |
| CMTM8 | N | 1168 | NM_178868 | Homo sapiens CKLF-like MARVEL transmembrane domain containing 8 (CMTM8), mRNA. | This gene belongs to the chemokine-like factor gene superfamily, a novel family that is similar to the chemokine and the transmembrane 4 superfamilies. This gene is one of several chemokine-like factor genes located in a cluster on chromosome 3. This gene is widely expressed in many tissues, but the exact function of the encoded protein is unknown. [provided by RefSeq, July 2008]. |
| FHIT | N | 1169 | NM_001166243 | Homo sapiens fragile histidine triad gene (FHIT), transcript variant 2, mRNA. | This gene, a member of the histidine triad gene family, encodes a diadenosine 5',5'''-P1,P3-triphosphate hydrolase involved in purine metabolism. The gene encompasses the common fragile site FRA3B on chromosome 3, where carcinogen-induced damage can lead to translocations and aberrant transcripts of this gene. In fact, aberrant transcripts from this gene have been found in about half of all esophageal, stomach, and colon carcinomas. Alternatively spliced transcript variants have been found for this gene. [provided by RefSeq, October 2009]. Transcript Variant: This variant (2) has an alternate splice site in the 3' UTR, as compared to variant 1. Both variants 1 and 2 encode the same protein. |
| FHIT | N | 1170 | NM_002012 | Homo sapiens fragile histidine triad gene (FHIT), transcript variant 1, mRNA. | This gene, a member of the histidine triad gene family, encodes a diadenosine 5',5'''-P1,P3-triphosphate hydrolase involved in purine metabolism. The gene encompasses the common fragile site FRA3B on chromosome 3, where carcinogen-induced damage can lead to translocations and aberrant transcripts of this gene. In fact, aberrant transcripts from this gene have been found in about half of all esophageal, stomach, and colon carcinomas. Alternatively spliced transcript variants have been found for this gene. [provided by RefSeq, October 2009]. Transcript Variant: This variant (1) is the longer transcript. |
| SYNGAP1 | N | 1171 | NM_006772 | Homo sapiens synaptic Ras GTPase activating protein 1 (SYNGAP1), mRNA. | The protein encoded by this gene is a major component of the postsynaptic density (PSD), a group of proteins found associated with NMDA receptors at synapses. The encoded protein is phosphorylated by calmodulin-dependent protein kinase II and dephosphorylated by NMDA receptor activation. Defects in this gene are a cause of mental retardation autosomal dominant type 5 (MRD5). [provided by RefSeq, December 2009]. Publication Note: This RefSeq record includes a subset of the publications that are available for this gene. Please see the Gene record to access additional publications. |
| CALN1 | N | 1172 | NM_001017440 | Homo sapiens calneuron 1 (CALN1), transcript variant 2, mRNA. | This gene encodes a protein with high similarity to the calcium-binding proteins of the calmodulin family. The encoded protein contains two EF-hand domains and potential calcium-binding sites. Alternative splicing results in multiple transcript variants. [provided by RefSeq, July 2008]. Transcript Variant: This variant (2) differs in the 5' UTR compared to variant 1. |
| CALN1 | N | 1173 | NM_031468 | Homo sapiens calneuron 1 (CALN1), transcript variant 1, mRNA. | This gene encodes a protein with high similarity to the calcium-binding proteins of the calmodulin family. The encoded protein contains two EF-hand domains and potential calcium-binding sites. Alternative splicing results in multiple transcript variants. [provided by RefSeq, July 2008]. Transcript Variant: This variant (1) represents the longer transcript. |
| LOH12CR1 | N | 1174 | NM_058169 | Homo sapiens loss of heterozygosity, 12, chromosomal region 1 (LOH12CR1), mRNA. | N/A |

TABLE 4-continued

| Gene name | Exon overlap | SEQ ID No | RefSeq Accession Number | mRNA Description | RefSeq Summary |
|---|---|---|---|---|---|
| FLT1 | N | 1175 | NM_001159920 | *Homo sapiens* fms-related tyrosine kinase 1 (vascular endothelial growth factor/vascular permeability factor receptor) (FLT1), transcript variant 2, mRNA. | This gene encodes a member of the vascular endothelial growth factor receptor (VEGFR) family. VEGFR family members are receptor tyrosine kinases (RTKs) which contain an extracellular ligand-binding region with seven immunoglobulin (Ig)-like domains, a transmembrane segment, and a tyrosine kinase (TK) domain within the cytoplasmic domain. This protein binds to VEGFR-A, VEGFR-B and placental growth factor and plays an important role in angiogenesis and vasculogenesis. Expression of this receptor is found in vascular endothelial cells, placental trophoblast cells and peripheral blood monocytes. Multiple transcript variants encoding different isoforms have been found for this gene. Isoforms include a full-length transmembrane receptor isoform and shortened, soluble isoforms. The soluble isoforms are associated with the onset of pre-eclampsia. [provided by RefSeq, May 2009]. Transcript Variant: This variant (2), also known as sFlt1 or sVEGFR-1, differs in the 3' coding region and 3' UTR, compared to variant 1. The encoded soluble protein (isoform 2) has a shorter, distinct C-terminus and lacks the transmembrane and cytoplasmic regions of isoform 1. Sequence Note: The RefSeq transcript and protein were derived from genomic sequence to make the sequence consistent with the reference genome assembly. The genomic coordinates used for the transcript record were based on alignments. |
| FLT1 | N | 1176 | NM_001160030 | *Homo sapiens* fms-related tyrosine kinase 1 (vascular endothelial growth factor/vascular permeability factor receptor) (FLT1), transcript variant 3, mRNA. | This gene encodes a member of the vascular endothelial growth factor receptor (VEGFR) family. VEGFR family members are receptor tyrosine kinases (RTKs) which contain an extracellular ligand-binding region with seven immunoglobulin (Ig)-like domains, a transmembrane segment, and a tyrosine kinase (TK) domain within the cytoplasmic domain. This protein binds to VEGFR-A, VEGFR-B and placental growth factor and plays an important role in angiogenesis and vasculogenesis. Expression of this receptor is found in vascular endothelial cells, placental trophoblast cells and peripheral blood monocytes. Multiple transcript variants encoding different isoforms have been found for this gene. Isoforms include a full-length transmembrane receptor isoform and shortened, soluble isoforms. The soluble isoforms are associated with the onset of pre-eclampsia. [provided by RefSeq, May 2009]. Transcript Variant: This variant (3) differs in the 3' coding region and 3' UTR, compared to variant 1. The encoded soluble protein (isoform 3) has a shorter, distinct C-terminus and lacks the transmembrane and cytoplasmic regions of isoform 1. |
| FLT1 | N | 1177 | NM_001160031 | *Homo sapiens* fms-related tyrosine kinase 1 (vascular endothelial growth factor/vascular permeability factor receptor) (FLT1), transcript variant 4, mRNA. | This gene encodes a member of the vascular endothelial growth factor receptor (VEGFR) family. VEGFR family members are receptor tyrosine kinases (RTKs) which contain an extracellular ligand-binding region with seven immunoglobulin (Ig)-like domains, a transmembrane segment, and a tyrosine kinase (TK) domain within the cytoplasmic domain. This protein binds to VEGFR-A, VEGFR-B and placental growth factor and plays an important role in angiogenesis and vasculogenesis. Expression of this receptor is found in vascular endothelial cells, placental trophoblast cells and peripheral blood monocytes. Multiple transcript variants encoding different isoforms have been found for this gene. Isoforms include a full-length transmembrane receptor isoform and shortened, soluble isoforms. The soluble isoforms are associated with the onset of pre-eclampsia. [provided by RefSeq, May 2009]. Transcript Variant: This variant (4) differs in the 3' coding region and 3' UTR, compared to variant 1. The encoded soluble protein (isoform 4) has a shorter, distinct C-terminus and lacks the transmembrane and cytoplasmic regions of isoform 1. |
| FLT1 | N | 1178 | NM_002019 | *Homo sapiens* fms-related tyrosine kinase 1 (vascular endothelial growth factor/vascular permeability factor receptor) (FLT1), transcript variant 1, mRNA. | This gene encodes a member of the vascular endothelial growth factor receptor (VEGFR) family. VEGFR family members are receptor tyrosine kinases (RTKs) which contain an extracellular ligand-binding region with seven immunoglobulin (Ig)-like domains, a transmembrane segment, and a tyrosine kinase (TK) domain within the cytoplasmic domain. This protein binds to VEGFR-A, VEGFR-B and placental growth factor and plays an important role in angiogenesis and vasculogenesis. Expression of this receptor is found in vascular endothelial cells, placental trophoblast cells and peripheral blood monocytes. Multiple transcript variants encoding different isoforms have been found for this gene. Isoforms include a full-length transmembrane receptor isoform and shortened, soluble isoforms. The soluble isoforms are associated with the onset of pre-eclampsia. [provided by RefSeq, May 2009]. Transcript Variant: This variant (1) the longest isoform (1). Isoform 1 is a transmembrane |

TABLE 4-continued

| Gene name | Exon overlap | SEQ ID No | RefSeq Accession Number | mRNA Description | RefSeq Summary |
|---|---|---|---|---|---|
| | | | | | protein. Sequence Note: This RefSeq record was created from transcript and genomic sequence data to make the sequence consistent with the reference genome assembly. The genomic coordinates used for the transcript record were based on transcript alignments. |
| CTAGE5 | N | 1179 | NM_001247988 | Homo sapiens CTAGE family, member 5 (CTAGE5), transcript variant 5, mRNA. | The protein encoded by this gene is a tumor-associated antigen found in cutaneous T-cell lymphoma and several other cancers. Autoantibodies against the encoded protein have been found in some cancers. Several transcript variants encoding different isoforms have been found for this gene. [provided by RefSeq, October 2011]. Transcript Variant: This variant (5) differs in the 5' UTR and coding sequence, lacks an alternate in-frame exon, and uses an alternate in-frame splice junction at the 3' end of an exon compared to variant 6. The resulting isoform (5) is shorter at the N-terminus and lacks two internal segments compared to isoform 6. Sequence Note: This RefSeq record was created from transcript and genomic sequence data to make the sequence consistent with the reference genome assembly. The genomic coordinates used for the transcript record were based on transcript alignments. |
| CTAGE5 | N | 1180 | NM_001247989 | Homo sapiens CTAGE family, member 5 (CTAGE5), transcript variant 6, mRNA. | The protein encoded by this gene is a tumor-associated antigen found in cutaneous T-cell lymphoma and several other cancers. Autoantibodies against the encoded protein have been found in some cancers. Several transcript variants encoding different isoforms have been found for this gene. [provided by RefSeq, October 2011]. Transcript Variant: This variant (6) represents the longest transcript and encodes the longest isoform (6). Sequence Note: This RefSeq record was created from transcript and genomic sequence data to make the sequence consistent with the reference genome assembly. The genomic coordinates used for the transcript record were based on transcript alignments. |
| CTAGE5 | N | 1181 | NM_001247990 | Homo sapiens CTAGE family, member 5 (CTAGE5), transcript variant 7, mRNA. | The protein encoded by this gene is a tumor-associated antigen found in cutaneous T-cell lymphoma and several other cancers. Autoantibodies against the encoded protein have been found in some cancers. Several transcript variants encoding different isoforms have been found for this gene. [provided by RefSeq, October 2011]. Transcript Variant: This variant (7) lacks a portion of the 5' coding region and initiates translation at a downstream start codon compared to variant 6. The resulting isoform (7) is shorter at the N-terminus compared to isoform 6. Sequence Note: This RefSeq record was created from transcript and genomic sequence data to make the sequence consistent with the reference genome assembly. The genomic coordinates used for the transcript record were based on transcript alignments. |
| CTAGE5 | N | 1182 | NM_005930 | Homo sapiens CTAGE family, member 5 (CTAGE5), transcript variant 1, mRNA. | The protein encoded by this gene is a tumor-associated antigen found in cutaneous T-cell lymphoma and several other cancers. Autoantibodies against the encoded protein have been found in some cancers. Several transcript variants encoding different isoforms have been found for this gene. [provided by RefSeq, October 2011]. Transcript Variant: This variant (1) uses an alternate in-frame splice junction at the 3' end of an exon compared to variant 6. The resulting isoform (1) lacks an internal segment compared to isoform 6. |
| CTAGE5 | N | 1183 | NM_203354 | Homo sapiens CTAGE family, member 5 (CTAGE5), transcript variant 2, mRNA. | The protein encoded by this gene is a tumor-associated antigen found in cutaneous T-cell lymphoma and several other cancers. Autoantibodies against the encoded protein have been found in some cancers. Several transcript variants encoding different isoforms have been found for this gene. [provided by RefSeq, October 2011]. Transcript Variant: This variant (2) differs in the 5' UTR and coding sequence and uses an alternate in-frame splice junction at the 3' end of an exon compared to variant 6. The resulting isoform (2) has a shorter and distinct N-terminus and lacks an internal segment compared to isoform 6. |
| CTAGE5 | N | 1184 | NM_203355 | Homo sapiens CTAGE family, member 5 (CTAGE5), transcript variant 3, mRNA. | The protein encoded by this gene is a tumor-associated antigen found in cutaneous T-cell lymphoma and several other cancers. Autoantibodies against the encoded protein have been found in some cancers. Several transcript variants encoding different isoforms have been found for this gene. [provided by RefSeq, October 2011]. Transcript Variant: This variant (3) lacks an alternate in-frame exon and uses an alternate in-frame splice junction at the 3' end of an exon compared to variant 6. The resulting isoform (3) lacks two internal segments compared to isoform 6. |
| CTAGE5 | N | 1185 | NM_203356 | Homo sapiens CTAGE family, member 5 | The protein encoded by this gene is a tumor-associated antigen found in cutaneous T-cell lymphoma and several other cancers. Autoantibodies against the encoded protein have been found in some |

TABLE 4-continued

| Gene name | Exon overlap | SEQ ID No | RefSeq Accession Number | mRNA Description | RefSeq Summary |
|---|---|---|---|---|---|
| | | | | (CTAGE5), transcript variant 4, mRNA. | cancers. Several transcript variants encoding different isoforms have been found for this gene. [provided by RefSeq, October 2011]. Transcript Variant: This variant (4) differs in the 5' UTR and coding sequence, initiates translation at a downstream start codon, and uses an alternate in-frame splice junction at the 3' end of an exon compared to variant 6. The resulting isoform (4) is shorter at the N-terminus and lacks an internal segment compared to isoform 6. Unlike the other variants, this variant may exhibit testis-specific expression. |
| TTC7B | N | 1186 | NM_001010854 | *Homo sapiens* tetratricopeptide repeat domain 7B (TTC7B), mRNA. | N/A |
| LRRC49 | N | 1187 | NM_001199017 | *Homo sapiens* leucine rich repeat containing 49 (LRRC49), transcript variant 1, mRNA. | N/A |
| LRRC49 | N | 1188 | NM_001199018 | *Homo sapiens* leucine rich repeat containing 49 (LRRC49), transcript variant 3, mRNA. | N/A |
| LRRC49 | N | 1189 | NM_017691 | *Homo sapiens* leucine rich repeat containing 49 (LRRC49), transcript variant 2, mRNA. | N/A |
| MIR662 | Y | 1190 | NR_030384 | Homo sapiens microRNA 662 (MIR662), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MSLNL | Y | 1191 | NM_001025190 | *Homo sapiens* mesothelin-like (MSLNL), mRNA. | N/A |
| CHTF18 | Y | 1192 | NM_022092 | *Homo sapiens* CTF18, chromosome transmission fidelity factor 18 homolog (S. cerevisiae) (CHTF18), mRNA. | CHTF18, CHTF8 (MIM 613202), and DCC1 (DSCC1; MIM 613203) are components of an alternative replication factor C (RFC) (see MIM 600404) complex that loads PCNA (MIM 176740) onto DNA during S phase of the cell cycle (Merkle et al., 2003 [PubMed 12766176]; Bermudez et al., 2003 [PubMed 12930902]). [supplied by OMIM, December 2009]. |
| GNG13 | Y | 1193 | NM_016541 | *Homo sapiens* guanine nucleotide binding protein (G protein), gamma 13 (GNG13), mRNA. | Heterotrimeric G proteins, which consist of alpha (see MIM 139320), beta (see MIM 139380), and gamma subunits, function as signal transducers for the 7-transmembrane-helix G protein-coupled receptors. GNG13 is a gamma subunit that is expressed in taste, retinal, and neuronal tissues and plays a key role in taste transduction (Li et al., 2006 [PubMed 16473877]). [supplied by OMIM, October 2009]. |
| PRR25 | Y | 1194 | NM_001013638 | *Homo sapiens* proline rich 25 (PRR25), mRNA. | N/A |

TABLE 4-continued

| Gene name | Exon overlap | SEQ ID No | RefSeq Accession Number | mRNA Description | RefSeq Summary |
|---|---|---|---|---|---|
| RPUSD1 | Y | 1195 | NM_058192 | *Homo sapiens* RNA pseudouridylate synthase domain containing 1 (RPUSD1), mRNA. | N/A |
| HKR1 | N | 1196 | NM_181786 | *Homo sapiens* HKR1, GLI-Kruppel zinc finger family member (HKR1), mRNA. | N/A |
| HMX1 | both | 1197 | NM_018942 | *Homo sapiens* H6 family homeobox 1 (HMX1), mRNA. | This gene encodes a transcription factor that belongs to the H6 family of homeobox proteins. This protein can bind a 5'-CAAG-3' core DNA sequence, and it is involved in the development of craniofacial structures. Mutations in this gene cause oculoauricular syndrome, a disorder of the eye and external ear. [provided by RefSeq, October 2009]. Sequence Note: The RefSeq transcript and protein were derived from genomic sequence to make the sequence consistent with the reference genome assembly. The genomic coordinates used for the transcript record were based on transcript alignments. |
| LOC284551 | Y | 1198 | NR_027085 | *Homo sapiens* uncharacterized LOC284551 (LOC284551), non-coding RNA. | N/A |
| ACOT11 | Y | 1199 | NM_015547 | *Homo sapiens* acyl-CoA thioesterase 11 (ACOT11), transcript variant 1, mRNA. | This gene encodes a member of the acyl-CoA thioesterase family which catalyse the conversion of activated fatty acids to the corresponding non-esterified fatty acid and coenzyme A. Expression of a mouse homolog in brown adipose tissue is induced by low temperatures and repressed by warm temperatures. Higher levels of expression of the mouse homolog has been found in obesity-resistant mice compared with obesity-prone mice, suggesting a role of acyl-CoA thioesterase 11 in obesity. Alternative splicing results in transcript variants. [provided by RefSeq, November 2010]. Transcript Variant: This variant (1) encodes the longer isoform (BFIT1) of this protein. |
| ACOT11 | Y | 1200 | NM_147161 | *Homo sapiens* acyl-CoA thioesterase 11 (ACOT11), transcript variant 2, mRNA. | This gene encodes a member of the acyl-CoA thioesterase family which catalyse the conversion of activated fatty acids to the corresponding non-esterified fatty acid and coenzyme A. Expression of a mouse homolog in brown adipose tissue is induced by low temperatures and repressed by warm temperatures. Higher levels of expression of the mouse homolog has been found in obesity-resistant mice compared with obesity-prone mice, suggesting a role of acyl-CoA thioesterase 11 in obesity. Alternative splicing results in transcript variants. [provided by RefSeq, November 2010]. Transcript Variant: This variant (2) uses alternate exons in the 3' coding region and UTR, compared to variant 1. The encoded isoform (BFIT2) has a distinct C-terminus compared to isoform BFIT1. Sequence Note: This RefSeq record was created from transcript and genomic sequence data to make the sequence consistent with the reference genome assembly. The genomic coordinates used for the transcript record were based on transcript alignments. |
| RBMS3 | N | 1201 | NM_001003792 | *Homo sapiens* RNA binding motif, single stranded interacting protein 3 (RBMS3), transcript variant 3, mRNA. | This gene encodes an RNA-binding protein that belongs to the c-myc gene single-strand binding protein family. These proteins are characterized by the presence of two sets of ribonucleoprotein consensus sequence (RNP-CS) that contain conserved motifs, RNP1 and RNP2, originally described in RNA binding proteins, and required for DNA binding. These proteins have been implicated in such diverse functions as DNA replication, gene transcription, cell cycle progression and apoptosis. The encoded protein was isolated by virtue of its binding to an upstream element of the alpha2(I) collagen promoter. The observation that this protein localizes mostly in the cytoplasm suggests that it may be involved in a cytoplasmic function such as controlling RNA metabolism, rather than transcription. Multiple alternatively spliced transcript variants encoding different isoforms have been found for this gene. [provided by RefSeq, April 2010]. Transcript Variant: This variant (3), also known as DD23-S, lacks a 3 nt segment and an in-frame exon in the coding region, as compared to variant 1. The encoded isoform 3 thus lacks an internal aa and an internal segment, as compared to isoform 1. Sequence Note: |

TABLE 4-continued

| Gene name | Exon overlap | SEQ ID No | RefSeq Accession Number | mRNA Description | RefSeq Summary |
|---|---|---|---|---|---|
| RBMS3 | N | 1202 | NM_001003793 | *Homo sapiens* RNA binding motif, single stranded interacting protein 3 (RBMS3), transcript variant 1, mRNA. | This RefSeq record was created from transcript and genomic sequence data to make the sequence consistent with the reference genome assembly. The genomic coordinates used for the transcript record were based on transcript alignments. This gene encodes an RNA-binding protein that belongs to the c-myc gene single-strand binding protein family. These proteins are characterized by the presence of two sets of ribonucleoprotein consensus sequence (RNP-CS) that contain conserved motifs, RNP1 and RNP2, originally described in RNA binding proteins, and required for DNA binding. These proteins have been implicated in such diverse functions as DNA replication, gene transcription, cell cycle progression and apoptosis. The encoded protein was isolated by virtue of its binding to an upstream element of the alpha2(I) collagen promoter. The observation that this protein localizes mostly in the cytoplasm suggests that it may be involved in a cytoplasmic function such as controlling RNA metabolism, rather than transcription. Multiple alternatively spliced transcript variants encoding different isoforms have been found for this gene. [provided by RefSeq, April 2010]. Transcript Variant: This variant (1), also known as DD23-L, encodes the longest isoform (1). Sequence Note: This RefSeq record was created from transcript and genomic sequence data to make the sequence consistent with the reference genome assembly. The genomic coordinates used for the transcript record were based on transcript alignments. |
| RBMS3 | N | 1203 | NM_001177711 | *Homo sapiens* RNA binding motif, single stranded interacting protein 3 (RBMS3), transcript variant 5, mRNA. | This gene encodes an RNA-binding protein that belongs to the c-myc gene single-strand binding protein family. These proteins are characterized by the presence of two sets of ribonucleoprotein consensus sequence (RNP-CS) that contain conserved motifs, RNP1 and RNP2, originally described in RNA binding proteins, and required for DNA binding. These proteins have been implicated in such diverse functions as DNA replication, gene transcription, cell cycle progression and apoptosis. The encoded protein was isolated by virtue of its binding to an upstream element of the alpha2(I) collagen promoter. The observation that this protein localizes mostly in the cytoplasm suggests that it may be involved in a cytoplasmic function such as controlling RNA metabolism, rather than transcription. Multiple alternatively spliced transcript variants encoding different isoforms have been found for this gene. [provided by RefSeq, April 2010]. Transcript Variant: This variant (5) lacks an in-frame exon in the coding region, compared to variant 1. The encoded isoform (5) is shorter than isoform 1. Sequence Note: This RefSeq record was created from transcript and genomic sequence data to make the sequence consistent with the reference genome assembly. The genomic coordinates used for the transcript record were based on transcript alignments. |
| RBMS3 | N | 1204 | NM_001177712 | *Homo sapiens* RNA binding motif, single stranded interacting protein 3 (RBMS3), transcript variant 4, mRNA. | This gene encodes an RNA-binding protein that belongs to the c-myc gene single-strand binding protein family. These proteins are characterized by the presence of two sets of ribonucleoprotein consensus sequence (RNP-CS) that contain conserved motifs, RNP1 and RNP2, originally described in RNA binding proteins, and required for DNA binding. These proteins have been implicated in such diverse functions as DNA replication, gene transcription, cell cycle progression and apoptosis. The encoded protein was isolated by virtue of its binding to an upstream element of the alpha2(I) collagen promoter. The observation that this protein localizes mostly in the cytoplasm suggests that it may be involved in a cytoplasmic function such as controlling RNA metabolism, rather than transcription. Multiple alternatively spliced transcript variants encoding different isoforms have been found for this gene. [provided by RefSeq, April 2010]. Transcript Variant: This variant (4) differs in the 3' UTR and has multiple differences in the coding region, compared to variant 1. The encoded isoform (4) is shorter and lacks the last aa, compared to isoform 1. Sequence Note: This RefSeq record was created from transcript and genomic sequence data to make the sequence consistent with the reference genome assembly. The genomic coordinates used for the transcript record were based on transcript alignments. |
| RBMS3 | N | 1205 | NM_014483 | *Homo sapiens* RNA binding motif, single stranded interacting protein 3 (RBMS3), transcript variant 2, mRNA. | This gene encodes an RNA-binding protein that belongs to the c-myc gene single-strand binding protein family. These proteins are characterized by the presence of two sets of ribonucleoprotein consensus sequence (RNP-CS) that contain conserved motifs, RNP1 and RNP2, originally described in RNA binding proteins, and required for DNA binding. These proteins have been implicated in such diverse functions as DNA replication, gene transcription, cell cycle progression and apoptosis. The |

TABLE 4-continued

| Gene name | Exon overlap | SEQ ID No | RefSeq Accession Number | mRNA Description | RefSeq Summary |
|---|---|---|---|---|---|
| | | | | | encoded protein was isolated by virtue of its binding to an upstream element of the alpha2(I) collagen promoter. The observation that this protein localizes mostly in the cytoplasm suggests that it may be involved in a cytoplasmic function such as controlling RNA metabolism, rather than transcription. Multiple alternatively spliced transcript variants encoding different isoforms have been found for this gene. [provided by RefSeq, April 2010]. Transcript Variant: This variant (2) lacks an internal in-frame exon and the last 3' exon, but has an alternate 3' segment, as compared to variant 1. The encoded isoform 2 lacks an internal segment and the last aa, as compared to isoform 1. Sequence Note: This RefSeq record was created from transcript and genomic sequence data to make the sequence consistent with the reference genome assembly. The genomic coordinates used for the transcript record were based on transcript alignments. |
| CCDC50 | N | 1206 | NM_174908 | Homo sapiens coiled-coil domain containing 50 (CCDC50), transcript variant 1, mRNA. | This gene encodes a soluble, cytoplasmic, tyrosine-phosphorylated protein with multiple ubiquitin-interacting domains. Mutations in this gene cause nonsyndromic, postlingual, progressive sensorineural DFNA44 hearing loss. In mouse, the protein is expressed in the inner ear during development and postnatal maturation and associates with microtubule-based structures. This protein may also function as a negative regulator of NF-kB signaling and as an effector of epidermal growth factor (EGF)-mediated cell signaling. Alternative splicing results in multiple transcript variants encoding distinct isoforms. [provided by RefSeq, October 2008]. Transcript Variant: This variant (1) lacks an in-frame exon in the coding region, compared to variant 2, and encodes the short isoform. Sequence Note: The RefSeq transcript and protein were derived from transcript and genomic sequence to make the sequence consistent with the reference genome assembly. The extent of this transcript is supported by transcript alignments. Publication Note: This RefSeq record includes a subset of the publications that are available for this gene. Please see the Gene record to access additional publications. |
| CCDC50 | N | 1207 | NM_178335 | Homo sapiens coiled-coil domain containing 50 (CCDC50), transcript variant 2, mRNA. | This gene encodes a soluble, cytoplasmic, tyrosine-phosphorylated protein with multiple ubiquitin-interacting domains. Mutations in this gene cause nonsyndromic, postlingual, progressive sensorineural DFNA44 hearing loss. In mouse, the protein is expressed in the inner ear during development and postnatal maturation and associates with microtubule-based structures. This protein may also function as a negative regulator of NF-kB signaling and as an effector of epidermal growth factor (EGF)-mediated cell signaling. Alternative splicing results in multiple transcript variants encoding distinct isoforms. [provided by RefSeq, October 2008]. Transcript Variant: This variant (2) represents the longer transcript and encodes the long isoform. Sequence Note: The RefSeq transcript and protein were derived from transcript and genomic sequence to make the sequence consistent with the reference genome assembly. The extent of this transcript is supported by transcript alignments. Publication Note: This RefSeq record includes a subset of the publications that are available for this gene. Please see the Gene record to access additional publications. |
| MOXD1 | N | 1208 | NM_015529 | Homo sapiens monooxygenase, DBH-like 1 (MOXD1), transcript variant 2, mRNA. | N/A |
| SDK1 | N | 1209 | NM_152744 | Homo sapiens sidekick homolog 1, cell adhesion molecule (chicken) (SDK1), transcript variant 1, mRNA. | N/A |
| SDK1 | N | 1210 | NR_027816 | Homo sapiens sidekick homolog 1, cell adhesion molecule (chicken) (SDK1), transcript variant 2, non-coding RNA. | N/A |
| ABCA13 | N | 1211 | NM_152701 | Homo sapiens ATP-binding cassette, sub-family A | In human, the ATP-binding cassette (ABC) family of transmembrane transporters has at least 48 genes and 7 gene subfamilies. This gene is a member of ABC gene subfamily A (ABCA). Genes within the |

TABLE 4-continued

| Gene name | Exon overlap | SEQ ID No | RefSeq Accession Number | mRNA Description | RefSeq Summary |
|---|---|---|---|---|---|
| | | | | (ABC1), member 13 (ABCA13), mRNA. | ABCA family typically encode several thousand amino acids. Like other ABC transmembrane transporter proteins, this protein has 12 or more transmembrane alpha-helix domains that likely arrange to form a single central chamber with multiple substrate binding sites. It is also predicted to have two large extracellular domains and two nucleotide binding domains as is typical for ABCA proteins. Alternative splice variants have been described but their biological validity has not been demonstrated. [provided by RefSeq, March 2009]. Sequence Note: This RefSeq record was created from transcript and genomic sequence data to make the sequence consistent with the reference genome assembly. The genomic coordinates used for the transcript record were based on transcript alignments. |
| PALM2 | N | 1212 | NM_001037293 | *Homo sapiens* paralemmin 2 (PALM2), transcript variant 2, mRNA. | N/A |
| PALM2 | N | 1213 | NM_053016 | *Homo sapiens* paralemmin 2 (PALM2), transcript variant 1, mRNA. | N/A |
| PALM2-AKAP2 | N | 1214 | NM_007203 | *Homo sapiens* PALM2-AKAP2 readthrough (PALM2-AKAP2), transcript variant 1, mRNA. | PALM2-AKAP2 mRNAs are naturally occurring read-through products of the neighboring PALM2 and AKAP2 genes. The significance of these read-through mRNAs and the function the resulting fusion protein products have not yet been determined. Alternative splicing of this gene results in several transcript variants encoding different isoforms, but the full-length nature of some of these variants has not been defined. [provided by RefSeq, October 2010]. Transcript Variant: This variant (1) is a longer transcript and encodes the longer isoform (1). Sequence Note: This RefSeq record was created from transcript and genomic sequence data to make the sequence consistent with the reference genome assembly. The genomic coordinates used for the transcript record were based on transcript alignments. |
| PALM2-AKAP2 | N | 1215 | NM_147150 | *Homo sapiens* PALM2-AKAP2 readthrough (PALM2-AKAP2), transcript variant 2, mRNA. | PALM2-AKAP2 mRNAs are naturally occurring read-through products of the neighboring PALM2 and AKAP2 genes. The significance of these read-through mRNAs and the function the resulting fusion protein products have not yet been determined. Alternative splicing of this gene results in several transcript variants encoding different isoforms, but the full-length nature of some of these variants has not been defined. [provided by RefSeq, October 2010]. Transcript Variant: This variant (2) lacks an in-frame exon near the 3' coding region compared to variant 1. It encodes a shorter isoform (2) but has identical N- and C-termini to isoform 1. |
| GOLGA8E | Y | 1216 | NR_033350 | *Homo sapiens* golgin A8 family, member E (GOLGA8E), non-coding RNA. | N/A |
| GOLGA8IP | Y | 1217 | NR_024074 | *Homo sapiens* golgin A8 family, member I, pseudogene (GOLGA8IP), non-coding RNA. | N/A |
| HERC2P2 | Y | 1218 | NR_002824 | *Homo sapiens* hect domain and RLD 2 pseudogene 2 (HERC2P2), non-coding RNA. | N/A |
| HERC2P7 | Y | 1219 | NR_036470 | *Homo sapiens* hect domain and RLD 2 pseudogene 7 (HERC2P7), non-coding RNA. | N/A |
| CLEC18C | Y | 1220 | NM_173619 | *Homo sapiens* C-type lectin domain family 18, member C (CLEC18C), mRNA. | N/A |

TABLE 4-continued

| Gene name | Exon overlap | SEQ ID No | RefSeq Accession Number | mRNA Description | RefSeq Summary |
|---|---|---|---|---|---|
| EXOSC6 | Y | 1221 | NM_058219 | *Homo sapiens* exosome component 6 (EXOSC6), mRNA. | This gene product constitutes one of the subunits of the multisubunit particle called exosome, which mediates mRNA degradation. The composition of human exosome is similar to its yeast counterpart. This protein is homologous to the yeast Mtr3 protein. Its exact function is not known, however, it has been shown using a cell-free RNA decay system that the exosome is required for rapid degradation of unstable mRNAs containing AU-rich elements (AREs), but not for poly(A) shortening. The exosome does not recognize ARE-containing mRNAs on its own, but requires ARE-binding proteins that could interact with the exosome and recruit it to unstable mRNAs, thereby promoting their rapid degradation. [provided by RefSeq, July 2008]. |
| LOC729513 | Y | 1222 | NR_033959 | *Homo sapiens* SMG1 homolog, phosphatidylinositol 3-kinase-related kinase (*C. elegans*) pseudogene (LOC729513), non-coding RNA. | N/A |
| CNTNAP4 | N | 1223 | NM_033401 | *Homo sapiens* contactin associated protein-like 4 (CNTNAP4), transcript variant 1, mRNA. | This gene product belongs to the neurexin family, members of which function in the vertebrate nervous system as cell adhesion molecules and receptors. This protein, like other neurexin proteins, contains epidermal growth factor repeats and laminin G domains. In addition, it includes an F5/8 type C domain, discoidin/neuropilin- and fibrinogen-like domains, and thrombospondin N-terminal-like domains. Alternative splicing results in two transcript variants encoding different isoforms. [provided by RefSeq, July 2008]. Transcript Variant: This variant (1) encodes the longer isoform (1). Sequence Note: This RefSeq record was created from transcript and genomic sequence data because no single transcript was available for the full length of the gene. The extent of this transcript is supported by transcript alignments. |
| CNTNAP4 | N | 1224 | NM_138994 | *Homo sapiens* contactin associated protein-like 4 (CNTNAP4), transcript variant 2, mRNA. | This gene product belongs to the neurexin family, members of which function in the vertebrate nervous system as cell adhesion molecules and receptors. This protein, like other neurexin proteins, contains epidermal growth factor repeats and laminin G domains. In addition, it includes an F5/8 type C domain, discoidin/neuropilin- and fibrinogen-like domains, and thrombospondin N-terminal-like domains. Alternative splicing results in two transcript variants encoding different isoforms. [provided by RefSeq, July 2008]. Transcript Variant: This variant (2) uses an alternate exon in the 5′ UTR and CDS and lacks several coding exons, compared to variant 1. It encodes a shorter protein (isoform 2) which has a distinct N-terminus, compared to isoform 1. Sequence Note: This RefSeq record was created from transcript and genomic sequence data because no single transcript was available for the full length of the gene. The extent of this transcript is supported by transcript alignments. |
| FLJ34690 | N | 1225 | NR_034144 | *Homo sapiens* uncharacterized protein FLJ34690 (FLJ34690), transcript variant 2, non-coding RNA. | N/A |
| FLJ34690 | N | 1226 | NR_034145 | *Homo sapiens* uncharacterized protein FLJ34690 (FLJ34690), transcript variant 1, non-coding RNA. | N/A |
| DOK6 | N | 1227 | NM_152721 | *Homo sapiens* docking protein 6 (DOK6), mRNA. | DOK6 is a member of the DOK (see DOK1; MIM 602919) family of intracellular adaptors that play a role in the RET (MIM 164761) signaling cascade (Crowder et al., 2004 [PubMed 15286081]). [supplied by OMIM, March 2008]. Sequence Note: This RefSeq record was created from transcript and genomic sequence data to make the sequence consistent with the reference genome assembly. The genomic coordinates used for the transcript record were based on transcript alignments. |

TABLE 4-continued

| Gene name | Exon overlap | SEQ ID No | RefSeq Accession Number | mRNA Description | RefSeq Summary |
|---|---|---|---|---|---|
| EYA2 | N | 1228 | NM_005244 | *Homo sapiens* eyes absent homolog 2 (*Drosophila*) (EYA2), transcript variant 1, mRNA. | This gene encodes a member of the eyes absent (EYA) family of proteins. The encoded protein may be post-translationally modified and may play a role in eye development. A similar protein in mice can act as a transcriptional activator. Alternative splicing results in multiple transcript variants, but the full-length natures of all of these variants have not yet been determined. [provided by RefSeq, July 2009]. Transcript Variant: This variant (1), also known as EYA2l, represents the longer transcript and encodes the longer isoform (a). Sequence Note: The RefSeq transcript and protein were derived from genomic sequence to make the sequence consistent with the reference genome assembly. The genomic coordinates used for the transcript record were based on alignments. |
| EYA2 | N | 1229 | NM_172110 | *Homo sapiens* eyes absent homolog 2 (*Drosophila*) (EYA2), transcript variant 5, mRNA. | This gene encodes a member of the eyes absent (EYA) family of proteins. The encoded protein may be post-translationally modified and may play a role in eye development. A similar protein in mice can act as a transcriptional activator. Alternative splicing results in multiple transcript variants, but the full-length natures of all of these variants have not yet been determined. [provided by RefSeq, July 2009]. Transcript Variant: This variant (5) lacks an alternate in-frame segment in the 3' coding region, compared to variant 1, resulting in an isoform (e) that is shorter than isoform a. |
| DDT | Y | 1230 | NM_001084392 | *Homo sapiens* D-dopachrome tautomerase (DDT), transcript variant 2, mRNA. | D-dopachrome tautomerase converts D-dopachrome into 5,6-dihydroxyindole. The DDT gene is related to the migration inhibitory factor (MIF) in terms of sequence, enzyme activity, and gene structure. DDT and MIF are closely linked on chromosome 22. [provided by RefSeq, July 2008]. Transcript Variant: This variant (2) differs in the 5' UTR compared to variant 1. Variants 1 and 2 encode the same protein. |
| DDT | Y | 1231 | NM_001355 | *Homo sapiens* D-dopachrome tautomerase (DDT), transcript variant 1, mRNA. | D-dopachrome tautomerase converts D-dopachrome into 5,6-dihydroxyindole. The DDT gene is related to the migration inhibitory factor (MIF) in terms of sequence, enzyme activity, and gene structure. DDT and MIF are closely linked on chromosome 22. [provided by RefSeq, July 2008]. Transcript Variant: This variant (1) represents the longer transcript. Variants 1 and 2 encode the same protein. |
| DDTL | Y | 1232 | NM_001084393 | *Homo sapiens* D-dopachrome tautomerase-like (DDTL), mRNA. | N/A |
| GSTT2 | Y | 1233 | NM_000854 | *Homo sapiens* glutathione S-transferase theta 2 (GSTT2), mRNA. | Glutathione S-transferase (GSTs) theta 2 (GSTT2) is a member of a superfamily of proteins that catalyze the conjugation of reduced glutathione to a variety of electrophilic and hydrophobic compounds. Human GSTs can be divided into five main classes: Alpha, Mu, Pi, Theta, and Zeta. The theta class members GSTT1 and GSTT2 share 55% amino acid sequence identity and both are thought to have an important role in human carcinogenesis. The theta genes have a similar structure, being composed of five exons with identical exon/intron boundaries. [provided by RefSeq, July 2008]. Publication Note: This RefSeq record includes a subset of the publications that are available for this gene. Please see the Gene record to access additional publications. |
| GSTT2B | Y | 1234 | NM_001080843 | *Homo sapiens* glutathione S-transferase theta 2B (gene/pseudogene) (GSTT2B), mRNA. | N/A |
| GSTTP2 | Y | 1235 | NR_003082 | *Homo sapiens* glutathione S-transferase theta pseudogene 2 (GSTTP2), non-coding RNA. | N/A |
| LOC643837 | Y | 1236 | NR_015368 | *Homo sapiens* uncharacterized LOC643837 (LOC643837), non-coding RNA. | N/A |
| CCDC66 | N | 1237 | NM_001012506 | *Homo sapiens* coiled-coil domain containing 66 | N/A |

TABLE 4-continued

| Gene name | Exon overlap | SEQ ID No | RefSeq Accession Number | mRNA Description | RefSeq Summary |
|---|---|---|---|---|---|
| CCDC66 | N | 1238 | NM_001141947 | Homo sapiens coiled-coil domain containing 66 (CCDC66), transcript variant 2, mRNA. | N/A |
| CCDC66 | N | 1239 | NR_024460 | Homo sapiens coiled-coil domain containing 66 (CCDC66), transcript variant 3, non-coding RNA. | N/A |
| GRID2 | N | 1240 | NM_001510 | Homo sapiens glutamate receptor, ionotropic, delta 2 (GRID2), mRNA. | Human glutamate receptor delta-2 (GRID2) is a relatively new member of the family of ionotropic glutamate receptors which are the predominant excitatory neurotransmitter receptors in the mammalian brain. GRID2 is a predicted 1,007 amino acid protein that shares 97% identity with the mouse homolog which is expressed selectively in cerebellar Purkinje cells. A point mutation in mouse GRID2, associated with the phenotype named 'lurcher', in the heterozygous state leads to ataxia resulting from selective, cell-autonomous apoptosis of cerebellar Purkinje cells during postnatal development. Mice homozygous for this mutation die shortly after birth from massive loss of mid- and hindbrain neurons during late embryogenesis. This strongly suggests a role for GRID2 in neuronal apoptotic death. [provided by RefSeq, July 2008]. |
| GALNTL6 | N | 1241 | NM_001034845 | Homo sapiens UDP-N-acetyl-alpha-D-galactosamine:polypeptide N-acetylgalactosaminyl-transferase-like 6 (GALNTL6), mRNA. | N/A |
| KLHL3 | N | 1242 | NM_017415 | Homo sapiens kelch-like 3 (Drosophila) (KLHL3), mRNA. | N/A |
| HTR4 | N | 1243 | NM_000870 | Homo sapiens 5-hydroxytryptamine (serotonin) receptor 4 (HTR4), transcript variant b, mRNA. | This gene is a member of the family of serotonin receptors, which are G protein coupled receptors that stimulate cAMP production in response to serotonin (5-hydroxytryptamine). The gene product is a glycosylated transmembrane protein that functions in both the peripheral and central nervous system to modulate the release of various neurotransmitters. Multiple transcript variants encoding proteins with distinct C-terminal sequences have been described. [provided by RefSeq, May 2010]. Transcript Variant: This variant (b) encodes the longest isoform (b). |
| HTR4 | N | 1244 | NM_001040169 | Homo sapiens 5-hydroxytryptamine (serotonin) receptor 4 (HTR4), transcript variant a, mRNA. | This gene is a member of the family of serotonin receptors, which are G protein coupled receptors that stimulate cAMP production in response to serotonin (5-hydroxytryptamine). The gene product is a glycosylated transmembrane protein that functions in both the peripheral and central nervous system to modulate the release of various neurotransmitters. Multiple transcript variants encoding proteins with distinct C-terminal sequences have been described. [provided by RefSeq, May 2010]. Transcript Variant: This variant (a) differs in the 5' UTR, 3' coding region and 3' UTR, compared to variant b. The resulting isoform (a) has a distinct C-terminus and is shorter than isoform b. Publication Note: This RefSeq record includes a subset of the publications that are available for this gene. Please see the Gene record to access additional publications. |
| HTR4 | N | 1245 | NM_001040172 | Homo sapiens 5-hydroxytryptamine (serotonin) receptor 4 (HTR4), transcript variant d, mRNA. | This gene is a member of the family of serotonin receptors, which are G protein coupled receptors that stimulate cAMP production in response to serotonin (5-hydroxytryptamine). The gene product is a glycosylated transmembrane protein that functions in both the peripheral and central nervous system to modulate the release of various neurotransmitters. Multiple transcript variants encoding proteins with distinct C-terminal sequences have been described. [provided by RefSeq, May 2010]. Transcript |

TABLE 4-continued

| Gene name | Exon overlap | SEQ ID No | RefSeq Accession Number | mRNA Description | RefSeq Summary |
|---|---|---|---|---|---|
| HTR4 | N | 1246 | NM_001040173 | Homo sapiens 5-hydroxytryptamine (serotonin) receptor 4 (HTR4), transcript variant i, mRNA. | Variant: This variant (d) differs in the 5' UTR and uses an alternate 3' terminal exon compared to variant b. The encoded isoform (d) has a distinct C-terminus and is shorter than isoform b. Publication Note: This RefSeq record includes a subset of the publications that are available for this gene. Please see the Gene record to access additional publications. This gene is a member of the family of serotonin receptors, which are G protein coupled receptors that stimulate cAMP production in response to serotonin (5-hydroxytryptamine). The gene product is a glycosylated transmembrane protein that functions in both the peripheral and central nervous system to modulate the release of various neurotransmitters. Multiple transcript variants encoding proteins with distinct C-terminal sequences have been described. [provided by RefSeq, May 2010]. Transcript Variant: This variant (i) differs in the 5' UTR and includes an alternate in-frame exon, compared to variant b. This results in a longer protein (isoform i), compared to isoform b. |
| HTR4 | N | 1247 | NM_199453 | Homo sapiens 5-hydroxytryptamine (serotonin) receptor 4 (HTR4), transcript variant g, mRNA. | This gene is a member of the family of serotonin receptors, which are G protein coupled receptors that stimulate cAMP production in response to serotonin (5-hydroxytryptamine). The gene product is a glycosylated transmembrane protein that functions in both the peripheral and central nervous system to modulate the release of various neurotransmitters. Multiple transcript variants encoding proteins with distinct C-terminal sequences have been described. [provided by RefSeq, May 2010]. Transcript Variant: This variant (g), also known as E or G1 , differs in the 5' UTR, 3' coding region and 3' UTR, compared to variant 1. The resulting isoform (isoform g) has a distinct C-terminus and is shorter than isoform b. Publication Note: This RefSeq record includes a subset of the publications that are available for this gene. Please see the Gene record to access additional publications. |
| NKAIN2 | N | 1248 | NM_001040214 | Homo sapiens Na+/K+ transporting ATPase interacting 2 (NKAIN2), transcript variant 1, mRNA. | The protein encoded by this gene is a transmembrane protein that interacts with the beta subunit of Na,K-ATPase (ATP1B1). A chromosomal translocation involving this gene is a cause of lymphoma. At least two transcript variants encoding different isoforms have been found for this gene. [provided by RefSeq, May 2010]. Transcript Variant: This variant (1) represents the longer transcript and encodes the longer isoform (1). |
| NKAIN2 | N | 1249 | NM_153355 | Homo sapiens Na+/K+ transporting ATPase interacting 2 (NKAIN2), transcript variant 2, mRNA. | The protein encoded by this gene is a transmembrane protein that interacts with the beta subunit of Na,K-ATPase (ATP1B1). A chromosomal translocation involving this gene is a cause of lymphoma. At least two transcript variants encoding different isoforms have been found for this gene. [provided by RefSeq, May 2010]. Transcript Variant: This variant (2) lacks an alternate in-frame exon compared to variant 1. The resulting isoform (2) has the same N- and C-termini but is shorter compared to isoform 1. |
| STK31 | N | 1250 | NM_001122833 | Homo sapiens serine/threonine kinase 31 (STK31), transcript variant 3, mRNA. | This gene is similar to a mouse gene that encodes a putative protein kinase with a tudor domain, and shows testis-specific expression. Alternative splicing results in multiple transcript variants encoding different isoforms. [provided by RefSeq, July 2008]. Transcript Variant: This variant (3) uses an alternate splice-site in the 5' end that results in translation initiation at a downstream start codon, compared to variant 1. The encoded protein (isoform b) has a shorter N-terminus, compared to isoform a. |
| STK31 | N | 1251 | NM_031414 | Homo sapiens serine/threonine kinase 31 (STK31), transcript variant 1, mRNA. | This gene is similar to a mouse gene that encodes a putative protein kinase with a tudor domain, and shows testis-specific expression. Alternative splicing results in multiple transcript variants encoding different isoforms. [provided by RefSeq, July 2008]. Transcript Variant: This variant (1) encodes the longer isoform (a). |
| STK31 | N | 1252 | NM_032944 | Homo sapiens serine/threonine kinase 31 (STK31), transcript variant 2, mRNA. | This gene is similar to a mouse gene that encodes a putative protein kinase with a tudor domain, and shows testis-specific expression. Alternative splicing results in multiple transcript variants encoding different isoforms. [provided by RefSeq, July 2008]. Transcript Variant: This variant (2) uses an alternate splice-site in the 5' end that results in translation initiation at a downstream start codon, compared to variant 1. The encoded protein (isoform b) has a shorter N-terminus, compared to isoform a. |
| SNTG1 | N | 1253 | NM_018967 | Homo sapiens syntrophin, gamma 1 (SNTG1), mRNA. | The protein encoded by this gene is a member of the syntrophin family. Syntrophins are cytoplasmic peripheral membrane proteins that typically contain 2 pleckstrin homology (PH) domains, a PDZ domain that bisects the first PH domain, and a C-terminal domain that mediates dystrophin binding. This gene is specifically expressed in the brain. Transcript variants for this gene have been described, but their full-length nature has not been determined. [provided by RefSeq, July 2008]. |

TABLE 4-continued

| Gene name | Exon overlap | SEQ ID No | RefSeq Accession Number | mRNA Description | RefSeq Summary |
|---|---|---|---|---|---|
| IFNA22P | Y | 1254 | NR_036676 | *Homo sapiens* interferon, alpha 22, pseudogene (IFNA22P), non-coding RNA. | N/A |
| LINGO2 | N | 1255 | NM_152570 | *Homo sapiens* leucine rich repeat and Ig domain containing 2 (LINGO2), mRNA. | N/A |
| TMEM38B | N | 1256 | NM_018112 | *Homo sapiens* transmembrane protein 38B (TMEM38B), mRNA. | N/A |
| LARP4B | N | 1257 | NM_015155 | *Homo sapiens* La ribonucleoprotein domain family, member 4B (LARP4B), mRNA. | N/A |
| TYR | N | 1258 | NM_000372 | *Homo sapiens* tyrosinase (oculocutaneous albinism IA) (TYR), mRNA. | The enzyme encoded by this gene catalyzes the first 2 steps, and at least 1 subsequent step, in the conversion of tyrosine to melanin. The enzyme has both tyrosine hydroxylase and dopa oxidase catalytic activities, and requires copper for function. Mutations in this gene result in oculocutaneous albinism, and nonpathologic polymorphisms result in skin pigmentation variation. The human genome contains a pseudogene similar to the 3' half of this gene. [provided by RefSeq, October 2008]. |
| YAP1 | N | 1259 | NM_001130145 | *Homo sapiens* Yes-associated protein 1 (YAP1), transcript variant 1, mRNA. | This gene encodes the human ortholog of chicken YAP protein which binds to the SH3 domain of the Yes proto-oncogene product. This protein contains a WW domain that is found in various structural, regulatory and signaling molecules in yeast, nematode, and mammals, and may be involved in protein-protein interaction. [provided by RefSeq, July 2008]. Transcript Variant: This variant (1) represents the longest transcript and encodes the longest protein (isoform 1). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| YAP1 | N | 1260 | NM_001195044 | *Homo sapiens* Yes-associated protein 1 (YAP1), transcript variant 3, mRNA. | This gene encodes the human ortholog of chicken YAP protein which binds to the SH3 domain of the Yes proto-oncogene product. This protein contains a WW domain that is found in various structural, regulatory and signaling molecules in yeast, nematode, and mammals, and may be involved in protein-protein interaction. [provided by RefSeq, July 2008]. Transcript Variant: This variant (3) lacks an alternate in-frame exon in the 3' coding region, compared to variant 1. This results in a shorter protein (isoform 3), compared to isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| YAP1 | N | 1261 | NM_001195045 | *Homo sapiens* Yes-associated protein 1 (YAP1), transcript variant 4, mRNA. | This gene encodes the human ortholog of chicken YAP protein which binds to the SH3 domain of the Yes proto-oncogene product. This protein contains a WW domain that is found in various structural, regulatory and signaling molecules in yeast, nematode, and mammals, and may be involved in protein-protein interaction. [provided by RefSeq, July 2008]. Transcript Variant: This variant (4) differs in the 5' UTR, lacks a portion of the 5' coding region, and initiates translation at a downstream start codon, compared to variant 1. The encoded isoform (4) is shorter than isoform 1. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |

TABLE 4-continued

| Gene name | Exon overlap | SEQ ID No | RefSeq Accession Number | mRNA Description | RefSeq Summary |
|---|---|---|---|---|---|
| YAP1 | N | 1262 | NM_006106 | *Homo sapiens* Yes-associated protein 1 (YAP1), transcript variant 2, mRNA. | This gene encodes the human ortholog of chicken YAP protein which binds to the SH3 domain of the Yes proto-oncogene product. This protein contains a WW domain that is found in various structural, regulatory and signaling molecules in yeast, nematode, and mammals, and may be involved in protein-protein interaction. [provided by RefSeq, July 2008]. Transcript Variant: This variant (2) lacks two alternate in-frame exons compared to variant 1. This results in a shorter protein (isoform 2), compared to isoform 1. Sequence Note: This RefSeq record was created from transcript and genomic sequence data to make the sequence consistent with the reference genome assembly. The genomic coordinates used for the transcript record were based on transcript alignments. |
| SLC35F2 | N | 1263 | NM_017515 | *Homo sapiens* solute carrier family 35, member F2 (SLC35F2), mRNA. | N/A |
| NTM | N | 1264 | NM_001048209 | *Homo sapiens* neurotrimin (NTM), transcript variant 2, mRNA. | This gene encodes a member of the IgLON (LAMP, OBCAM, Ntm) family of immunoglobulin (Ig) domain-containing glycosylphosphatidylinositol (GPI)-anchored cell adhesion molecules. The encoded protein may promote neurite outgrowth and adhesion via a homophilic mechanism. This gene is closely linked to a related family member, opioid binding protein/cell adhesion molecule-like (OPCML), on chromosome 11. Multiple transcript variants encoding different isoforms have been found for this gene. [provided by RefSeq, January 2009]. Transcript Variant: This variant (2) differs in the 5' UTR and in the coding region compared to variant 3, resulting in a protein that maintains the reading frame but is shorter and has a distinct N-terminus, compared to isoform 3. |
| NTM | N | 1265 | NM_001144058 | *Homo sapiens* neurotrimin (NTM), transcript variant 3, mRNA. | This gene encodes a member of the IgLON (LAMP, OBCAM, Ntm) family of immunoglobulin (Ig) domain-containing glycosylphosphatidylinositol (GPI)-anchored cell adhesion molecules. The encoded protein may promote neurite outgrowth and adhesion via a homophilic mechanism. This gene is closely linked to a related family member, opioid binding protein/cell adhesion molecule-like (OPCML), on chromosome 11. Multiple transcript variants encoding different isoforms have been found for this gene. [provided by RefSeq, January 2009]. Transcript Variant: This variant (3) encodes the longest isoform (3). Sequence Note: The RefSeq transcript and protein were derived from genomic sequence to make the sequence consistent with the reference genome assembly. The genomic coordinates used for the transcript record were based on alignments. |
| NTM | N | 1266 | NM_001144059 | *Homo sapiens* neurotrimin (NTM), transcript variant 4, mRNA. | This gene encodes a member of the IgLON (LAMP, OBCAM, Ntm) family of immunoglobulin (Ig) domain-containing glycosylphosphatidylinositol (GPI)-anchored cell adhesion molecules. The encoded protein may promote neurite outgrowth and adhesion via a homophilic mechanism. This gene is closely linked to a related family member, opioid binding protein/cell adhesion molecule-like (OPCML), on chromosome 11. Multiple transcript variants encoding different isoforms have been found for this gene. [provided by RefSeq, January 2009]. Transcript Variant: This variant (4) differs in the 3' coding region and 3' UTR compared to variant 3. The resulting protein (isoform 4) has a distinct C-terminus, compared to isoform 3. Sequence Note: The RefSeq transcript and protein were derived from genomic sequence to make the sequence consistent with the reference genome assembly. The genomic coordinates used for the transcript record were based on alignments. |
| NTM | N | 1267 | NM_016522 | *Homo sapiens* neurotrimin (NTM), transcript variant 1, mRNA. | This gene encodes a member of the IgLON (LAMP, OBCAM, Ntm) family of immunoglobulin (Ig) domain-containing glycosylphosphatidylinositol (GPI)-anchored cell adhesion molecules. The encoded protein may promote neurite outgrowth and adhesion via a homophilic mechanism. This gene is closely linked to a related family member, opioid binding protein/cell adhesion molecule-like (OPCML), on chromosome 11. Multiple transcript variants encoding different isoforms have been found for this gene. [provided by RefSeq, January 2009]. Transcript Variant: This variant (1) lacks an alternate exon in the 3' coding region, compared to variant 3. This variant encodes isoform 1, which is shorter than isoform 3. |

TABLE 4-continued

| Gene name | Exon overlap | SEQ ID No | RefSeq Accession Number | mRNA Description | RefSeq Summary |
|---|---|---|---|---|---|
| ITGBL1 | N | 1268 | NM_004791 | *Homo sapiens* integrin, beta-like 1 (with EGF-like repeat domains) (ITGBL1), mRNA. | N/A |
| FGF14 | N | 1269 | NM_004115 | *Homo sapiens* fibroblast growth factor 14 (FGF14), transcript variant 1, mRNA. | The protein encoded by this gene is a member of the fibroblast growth factor (FGF) family. FGF family members possess broad mitogenic and cell survival activities, and are involved in a variety of biological processes, including embryonic development, cell growth, morphogenesis, tissue repair, tumor growth and invasion. A mutation in this gene is associated with autosomal dominant cerebral ataxia. Alternatively spliced transcript variants have been found for this gene. [provided by RefSeq, July 2008]. Transcript Variant: This variant (1) encodes the shorter isoform (1A). Sequence Note: This RefSeq record was created from transcript and genomic sequence data because no single transcript was available for the full length of the gene. The extent of this transcript is supported by transcript alignments. |
| FGF14 | N | 1270 | NM_175929 | *Homo sapiens* fibroblast growth factor 14 (FGF14), transcript variant 2, mRNA. | The protein encoded by this gene is a member of the fibroblast growth factor (FGF) family. FGF family members possess broad mitogenic and cell survival activities, and are involved in a variety of biological processes, including embryonic development, cell growth, morphogenesis, tissue repair, tumor growth and invasion. A mutation in this gene is associated with autosomal dominant cerebral ataxia. Alternatively spliced transcript variants have been found for this gene. [provided by RefSeq, July 2008]. Transcript Variant: This variant (2) has an alternate 5' sequence including the 5' UTR and coding region. as compared to variant 1. It encodes isoform 1B, which has a different and longer N-terminus than isoform 1A. Sequence Note: This RefSeq record was created from transcript and genomic sequence data because no single transcript was available for the full length of the gene. The extent of this transcript is supported by transcript alignments. |
| QPRT | Y | 1271 | NM_014298 | *Homo sapiens* quinolinate phosphoribosyltransferase (QPRT), mRNA. | This gene encodes a key enzyme in catabolism of quinolinate, an intermediate in the tryptophan-nicotinamide adenine dinucleotide pathway. Quinolinate acts as a most potent endogenous excitotoxin to neurons. Elevation of quinolinate levels in the brain has been linked to the pathogenesis of neurodegenerative disorders such as epilepsy, Alzheimer's disease, and Huntington's disease. [provided by RefSeq, July 2008]. |
| SPN | Y | 1272 | NM_001030288 | *Homo sapiens* sialophorin (SPN), transcript variant 1, mRNA. | The protein encoded by this gene is a major sialoglycoprotein found on the surface of thymocytes, T lymphocytes, monocytes, granulocytes, and some B lymphocytes. It may be part of a physiologic ligand-receptor complex involved in T-cell activation. During T-cell activation, this protein is actively removed from the T-cell-APC (antigen-presenting cell) contact site, suggesting a negative regulatory role in adaptive immune response. [provided by RefSeq, September 2011]. |
| SPN | Y | 1273 | NM_003123 | *Homo sapiens* sialophorin (SPN), transcript variant 2, mRNA. | The protein encoded by this gene is a major sialoglycoprotein found on the surface of thymocytes, T lymphocytes, monocytes, granulocytes, and some B lymphocytes. It may be part of a physiologic ligand-receptor complex involved in T-cell activation. During T-cell activation, this protein is actively removed from the T-cell-APC (antigen-presenting cell) contact site, suggesting a negative regulatory role in adaptive immune response. [provided by RefSeq, September 2011]. |
| ALDOA | Y | 1274 | NM_000034 | *Homo sapiens* aldolase A, fructose-bisphosphate (ALDOA), transcript variant 1, mRNA. | The protein encoded by this gene, Aldolase A (fructose-bisphosphate aldolase), is a glycolytic enzyme that catalyzes the reversible conversion of fructose-1,6-bisphosphate to glyceraldehyde 3-phosphate and dihydroxyacetone phosphate. Three aldolase isozymes (A, B, and C), encoded by three different genes, are differentially expressed during development. Aldolase A is found in the developing embryo and is produced in even greater amounts in adult muscle. Aldolase A expression is repressed in adult liver, kidney and intestine and similar to aldolase C levels in brain and other nervous tissue. Aldolase A deficiency has been associated with myopathy and hemolytic anemia. Alternative splicing and alternative promoter usage results in multiple transcript variants. Related pseudogenes have been identified on chromosomes 3 and 10. [provided by RefSeq, August 2011]. Transcript Variant: This variant (1) represents the longest transcript and encodes isoform 1. Variants 2-4 encode the same isoform. |

TABLE 4-continued

| Gene name | Exon overlap | SEQ ID No | RefSeq Accession Number | mRNA Description | RefSeq Summary |
|---|---|---|---|---|---|
| ALDOA | Y | 1275 | NM_001127617 | *Homo sapiens* aldolase A, fructose-bisphosphate (ALDOA), transcript variant 4, mRNA. | The protein encoded by this gene, Aldolase A (fructose-bisphosphate aldolase), is a glycolytic enzyme that catalyzes the reversible conversion of fructose-1,6-bisphosphate to glyceraldehyde 3-phosphate and dihydroxyacetone phosphate. Three aldolase isozymes (A, B, and C), encoded by three different genes, are differentially expressed during development. Aldolase A is found in the developing embryo and is produced in even greater amounts in adult muscle. Aldolase A expression is repressed in adult liver, kidney and intestine and similar to aldolase C levels in brain and other nervous tissue. Aldolase A deficiency has been associated with myopathy and hemolytic anemia. Alternative splicing and alternative promoter usage results in multiple transcript variants. Related pseudogenes have been identified on chromosomes 3 and 10. [provided by RefSeq, August 2011]. Transcript Variant: This variant (4) differs in the 5' UTR, compared to variant 1. Variants 1-4 encode the same isoform (1). |
| ALDOA | Y | 1276 | NM_001243177 | *Homo sapiens* aldolase A, fructose-bisphosphate (ALDOA), transcript variant 6, mRNA. | The protein encoded by this gene, Aldolase A (fructose-bisphosphate aldolase), is a glycolytic enzyme that catalyzes the reversible conversion of fructose-1,6-bisphosphate to glyceraldehyde 3-phosphate and dihydroxyacetone phosphate. Three aldolase isozymes (A, B, and C), encoded by three different genes, are differentially expressed during development. Aldolase A is found in the developing embryo and is produced in even greater amounts in adult muscle. Aldolase A expression is repressed in adult liver, kidney and intestine and similar to aldolase C levels in brain and other nervous tissue. Aldolase A deficiency has been associated with myopathy and hemolytic anemia. Alternative splicing and alternative promoter usage results in multiple transcript variants. Related pseudogenes have been identified on chromosomes 3 and 10. [provided by RefSeq, August 2011]. Transcript Variant: This variant (6) differs in the 5' UTR and 5' coding region, and uses an alternate start codon, compared to variant 1. The resulting isoform (2) is longer at the N-terminus, compared to variant 1. |
| ALDOA | Y | 1277 | NM_184041 | *Homo sapiens* aldolase A, fructose-bisphosphate (ALDOA), transcript variant 2, mRNA. | The protein encoded by this gene, Aldolase A (fructose-bisphosphate aldolase), is a glycolytic enzyme that catalyzes the reversible conversion of fructose-1,6-bisphosphate to glyceraldehyde 3-phosphate and dihydroxyacetone phosphate. Three aldolase isozymes (A, B, and C), encoded by three different genes, are differentially expressed during development. Aldolase A is found in the developing embryo and is produced in even greater amounts in adult muscle. Aldolase A expression is repressed in adult liver, kidney and intestine and similar to aldolase C levels in brain and other nervous tissue. Aldolase A deficiency has been associated with myopathy and hemolytic anemia. Alternative splicing and alternative promoter usage results in multiple transcript variants. Related pseudogenes have been identified on chromosomes 3 and 10. [provided by RefSeq, August 2011]. Transcript Variant: This variant (2) differs in the 5' UTR, compared to variant 1. Variants 1-4 encode the same isoform (1). |
| ALDOA | Y | 1278 | NM_184043 | *Homo sapiens* aldolase A, fructose-bisphosphate (ALDOA), transcript variant 3, mRNA. | The protein encoded by this gene, Aldolase A (fructose-bisphosphate aldolase), is a glycolytic enzyme that catalyzes the reversible conversion of fructose-1,6-bisphosphate to glyceraldehyde 3-phosphate and dihydroxyacetone phosphate. Three aldolase isozymes (A, B, and C), encoded by three different genes, are differentially expressed during development. Aldolase A is found in the developing embryo and is produced in even greater amounts in adult muscle. Aldolase A expression is repressed in adult liver, kidney and intestine and similar to aldolase C levels in brain and other nervous tissue. Aldolase A deficiency has been associated with myopathy and hemolytic anemia. Alternative splicing and alternative promoter usage results in multiple transcript variants. Related pseudogenes have been identified on chromosomes 3 and 10. [provided by RefSeq, August 2011]. Transcript Variant: This variant (3) differs in the 5' UTR, compared to variant 1. Variants 1-4 encode the same isoform (1). |
| ASPHD1 | Y | 1279 | NM_181718 | *Homo sapiens* aspartate beta-hydroxylase domain containing 1 (ASPHD1), mRNA. | N/A |
| C16orf53 | Y | 1280 | NM_024516 | *Homo sapiens* chromosome 16 open reading frame 53 (C16orf53), mRNA. | C16ORF53 (PA1) is a component of a Set1-like multiprotein histone methyltransferase complex (Cho et al., 2007 [PubMed 17500065]). [supplied by OMIM, May 2008]. Sequence Note: This RefSeq record was created from transcript and genomic sequence data because no single transcript was available for the full length of the gene. The extent of this transcript is supported by transcript alignments. |

TABLE 4-continued

| Gene name | Exon overlap | SEQ ID No | RefSeq Accession Number | mRNA Description | RefSeq Summary |
|---|---|---|---|---|---|
| C16orf54 | Y | 1281 | NM_175900 | *Homo sapiens* chromosome 16 open reading frame 54 (C16orf54), mRNA. | N/A |
| C16orf92 | Y | 1282 | NM_001109659 | *Homo sapiens* chromosome 16 open reading frame 92 (C16orf92), transcript variant 1, mRNA. | N/A |
| C16orf92 | Y | 1283 | NM_001109660 | *Homo sapiens* chromosome 16 open reading frame 92 (C16orf92), transcript variant 2, mRNA. | N/A |
| CDIPT | Y | 1284 | NM_006319 | *Homo sapiens* CDP-diacylglycerol--inositol 3-phosphatidyltransferase (CDIPT), mRNA. | Phosphatidylinositol breakdown products are ubiquitous second messengers that function downstream of many G protein-coupled receptors and tyrosine kinases regulating cell growth, calcium metabolism, and protein kinase C activity. Two enzymes, CDP-diacylglycerol synthase and phosphatidylinositol synthase, are involved in the biosynthesis of phosphatidylinositol. Phosphatidylinositol synthase, a member of the CDP-alcohol phosphatidyl transferase class-I family, is an integral membrane protein found on the cytoplasmic side of the endoplasmic reticulum and the Golgi apparatus. [provided by RefSeq, July 2008]. |
| CORO1A | Y | 1285 | NM_001193333 | *Homo sapiens* coronin, actin binding protein, 1A (CORO1A), transcript variant 1, mRNA. | This gene encodes a member of the WD repeat protein family. WD repeats are minimally conserved regions of approximately 40 amino acids typically bracketed by gly-his and tip-asp (GH-WD), which may facilitate formation of heterotrimeric or multiprotein complexes. Members of this family are involved in a variety of cellular processes, including cell cycle progression, signal transduction, apoptosis, and gene regulation. Alternative splicing results in multiple transcript variants. A related pseudogene has been defined on chromosome 16. [provided by RefSeq, September 2010]. Transcript Variant: This variant (1) represents the longer transcript. Both variants 1 and 2 encode the same protein. Publication Note: This RefSeq record includes a subset of the publications that are available for this gene. Please see the Gene record to access additional publications. |
| CORO1A | Y | 1286 | NM_007074 | *Homo sapiens* coronin, actin binding protein, 1A (CORO1A), transcript variant 2, mRNA. | This gene encodes a member of the WD repeat protein family. WD repeats are minimally conserved regions of approximately 40 amino acids typically bracketed by gly-his and tip-asp (GH-WD), which may facilitate formation of heterotrimeric or multiprotein complexes. Members of this family are involved in a variety of cellular processes, including cell cycle progression, signal transduction, apoptosis, and gene regulation. Alternative splicing results in multiple transcript variants. A related pseudogene has been defined on chromosome 16. [provided by RefSeq, September 2010]. Transcript Variant: This variant (2) differs in the 5′ UTR compared to variant 1. Both variants 1 and 2 encode the same protein. |
| DOC2A | Y | 1287 | NM_003586 | *Homo sapiens* double C2-like domains, alpha (DOC2A), mRNA. | There are at least two protein isoforms of the Double C2 protein, namely alpha (DOC2A) and beta (DOC2B), which contain two C2-like domains. DOC2A and DOC2B are encoded by different genes; these genes are at times confused with the unrelated DAB2 gene which was initially named DOC-2. DOC2A is mainly expressed in brain and is suggested to be involved in Ca(2+)-dependent neurotransmitter release. [provided by RefSeq, July 2008]. Publication Note: This RefSeq record includes a subset of the publications that are available for this gene. Please see the Gene record to access additional publications. |
| FAM57B | Y | 1288 | NM_031478 | *Homo sapiens* family with sequence similarity 57, member B (FAM57B), mRNA. | N/A |
| GDPD3 | Y | 1289 | NM_024307 | *Homo sapiens* glycerophosphodiester phosphodiesterase domain | N/A |

TABLE 4-continued

| Gene name | Exon overlap | SEQ ID No | RefSeq Accession Number | mRNA Description | RefSeq Summary |
|---|---|---|---|---|---|
| HIRIP3 | Y | 1290 | NM_001197323 | containing 3 (GDPD3), mRNA. Homo sapiens HIRA interacting protein 3 (HIRIP3), transcript variant 2, mRNA. | The HIRA protein shares sequence similarity with Hir1p and Hir2p, the two corepressors of histone gene transcription characterized in the yeast, *Saccharomyces cerevisiae*. The structural features of the HIRA protein suggest that it may function as part of a multiprotein complex. Several cDNAs encoding HIRA-interacting proteins, or HIRIPs, have been identified. In vitro, the protein encoded by this gene binds HIRA, as well as H2B and H3 core histones, indicating that a complex containing HIRA-HIRIP3 could function in some aspects of chromatin and histone metabolism. Alternatively spliced transcript variants encoding distinct isoforms have been found for this gene. [provided by RefSeq, August 2011]. Transcript Variant: This variant (2) lacks an exon in the coding region, resulting in frame-shift, compared to variant 1. The resulting isoform (2) is shorter and has a distinct C-terminus, compared to isoform 1. |
| HIRIP3 | Y | 1291 | NM_003609 | Homo sapiens HIRA interacting protein 3 (HIRIP3), transcript variant 1, mRNA. | The HIRA protein shares sequence similarity with Hir1p and Hir2p, the two corepressors of histone gene transcription characterized in the yeast, *Saccharomyces cerevisiae*. The structural features of the HIRA protein suggest that it may function as part of a multiprotein complex. Several cDNAs encoding HIRA-interacting proteins, or HIRIPs, have been identified. In vitro, the protein encoded by this gene binds HIRA, as well as H2B and H3 core histones, indicating that a complex containing HIRA-HIRIP3 could function in some aspects of chromatin and histone metabolism. Alternatively spliced transcript variants encoding distinct isoforms have been found for this gene. [provided by RefSeq, August 2011]. Transcript Variant: This variant (1) encodes the longer isoform (1). |
| INO80E | Y | 1292 | NM_173618 | Homo sapiens INO80 complex subunit E (INO80E), mRNA. | N/A |
| KCTD13 | Y | 1293 | NM_178863 | Homo sapiens potassium channel tetramerisation domain containing 13 (KCTD13), mRNA. | N/A |
| LOC440356 | Y | 1294 | NR_015396 | Homo sapiens uncharacterized LOC440356 (LOC440356), transcript variant 1, non-coding RNA. | N/A |
| LOC440356 | Y | 1295 | NR_024370 | Homo sapiens uncharacterized LOC440356 (LOC440356), transcript variant 2, non-coding RNA. | N/A |
| MAZ | Y | 1296 | NM_001042539 | Homo sapiens MYC-associated zinc finger protein (purine-binding transcription factor) (MAZ), transcript variant 2, mRNA. | N/A |
| MAZ | Y | 1297 | NM_002383 | Homo sapiens MYC-associated zinc finger protein (purine-binding transcription factor) (MAZ), transcript variant 1, mRNA. | N/A |
| MVP | Y | 1298 | NM_005115 | Homo sapiens major vault protein (MVP), transcript variant 2, mRNA. | This gene encodes the major vault protein which is a lung resistance-related protein. Vaults are multi-subunit structures that may be involved in nucleo-cytoplasmic transport. This protein mediates drug resistance, perhaps via a transport process. It is widely distributed in normal tissues, and overexpressed in multidrug-resistant cancer cells. The protein overexpression is a potentially useful marker of clinical |

TABLE 4-continued

| Gene name | Exon overlap | SEQ ID No | RefSeq Accession Number | mRNA Description | RefSeq Summary |
|---|---|---|---|---|---|
| | | | | | drug resistance. This gene produces two transcripts by using two alternative exon 2 sequences; however, the open reading frames are the same in both transcripts. [provided by RefSeq, July 2008]. Transcript Variant: This variant (2) uses a different splice site in the 5′ UTR, compared to variant 1. Variants 1 and 2 encode the same protein. Publication Note: This RefSeq record includes a subset of the publications that are available for this gene. Please see the Gene record to access additional publications. |
| MVP | Y | 1299 | NM_017458 | Homo sapiens major vault protein (MVP), transcript variant 1, mRNA. | This gene encodes the major vault protein which is a lung resistance-related protein. Vaults are multi-subunit structures that may be involved in nucleo-cytoplasmic transport. This protein mediates drug resistance, perhaps via a transport process. It is widely distributed in normal tissues, and overexpressed in multidrug-resistant cancer cells. The protein overexpression is a potentially useful marker of clinical drug resistance. This gene produces two transcripts by using two alternative exon 2 sequences; however, the open reading frames are the same in both transcripts. Variants 1 and 2 encode the same protein. [provided by RefSeq, July 2008]. Transcript Variant: This variant (1) is the longer transcript. Variants 1 and 2 encode the same protein. Publication Note: This RefSeq record includes a subset of the publications that are available for this gene. Please see the Gene record to access additional publications. |
| PPP4C | Y | 1300 | NM_002720 | Homo sapiens protein phosphatase 4, catalytic subunit (PPP4C), mRNA. | N/A |
| PRRT2 | Y | 1301 | NM_145239 | Homo sapiens proline-rich transmembrane protein 2 (PRRT2), mRNA. | N/A |
| SEZ6L2 | Y | 1302 | NM_001114099 | Homo sapiens seizure related 6 homolog (mouse)-like 2 (SEZ6L2), transcript variant 3, mRNA. | This gene encodes a seizure-related protein that is localized on the cell surface. The gene is located in a region of chromosome 16p11.2 that is thought to contain candidate genes for autism spectrum disorders (ASD), though there is no evidence directly implicating this gene in ASD. Increased expression of this gene has been found in lung cancers, and the protein is therefore considered to be a novel prognostic marker for lung cancer. Alternative splicing of this gene results in multiple transcript variants. [provided by RefSeq, August 2011]. Transcript Variant: This variant (3) uses an alternate in-frame splice site in the 5′ coding region, and lacks an alternate in-frame exon in the 3′ coding region, compared to variant 5. The encoded isoform (3) is shorter than isoform 5. |
| SEZ6L2 | Y | 1303 | NM_001114100 | Homo sapiens seizure related 6 homolog (mouse)-like 2 (SEZ6L2), transcript variant 4, mRNA. | This gene encodes a seizure-related protein that is localized on the cell surface. The gene is located in a region of chromosome 16p11.2 that is thought to contain candidate genes for autism spectrum disorders (ASD), though there is no evidence directly implicating this gene in ASD. Increased expression of this gene has been found in lung cancers, and the protein is therefore considered to be a novel prognostic marker for lung cancer. Alternative splicing of this gene results in multiple transcript variants. [provided by RefSeq, August 2011]. Transcript Variant: This variant (4) lacks two alternate exons resulting in the loss of an in-frame segment in the 5′ coding region, compared to variant 5. The encoded isoform (4) is shorter than isoform 5. |
| SEZ6L2 | Y | 1304 | NM_001243332 | Homo sapiens seizure related 6 homolog (mouse)-like 2 (SEZ6L2), transcript variant 5, mRNA. | This gene encodes a seizure-related protein that is localized on the cell surface. The gene is located in a region of chromosome 16p11.2 that is thought to contain candidate genes for autism spectrum disorders (ASD), though there is no evidence directly implicating this gene in ASD. Increased expression of this gene has been found in lung cancers, and the protein is therefore considered to be a novel prognostic marker for lung cancer. Alternative splicing of this gene results in multiple transcript variants. [provided by RefSeq, August 2011]. Transcript Variant: This variant (5) represents the longest transcript and encodes the longest isoform (5). |
| SEZ6L2 | Y | 1305 | NM_001243333 | Homo sapiens seizure related 6 homolog (mouse)-like 2 (SEZ6L2), transcript variant 6, mRNA. | This gene encodes a seizure-related protein that is localized on the cell surface. The gene is located in a region of chromosome 16p11.2 that is thought to contain candidate genes for autism spectrum disorders (ASD), though there is no evidence directly implicating this gene in ASD. Increased expression of this gene has been found in lung cancers, and the protein is therefore considered to be a novel prognostic marker for lung cancer. Alternative splicing of this gene results in multiple transcript |

TABLE 4-continued

| Gene name | Exon overlap | SEQ ID No | RefSeq Accession Number | mRNA Description | RefSeq Summary |
|---|---|---|---|---|---|
| SEZ6L2 | Y | 1306 | NM_012410 | Homo sapiens seizure related 6 homolog (mouse)-like 2 (SEZ6L2), transcript variant 1, mRNA. | variants. [provided by RefSeq, August 2011]. Transcript Variant: This variant (6) lacks an alternate in-frame exon in the 5' coding region, compared to variant 5, resulting in an isoform (6) that is shorter than isoform 5. This gene encodes a seizure-related protein that is localized on the cell surface. The gene is located in a region of chromosome 16p11.2 that is thought to contain candidate genes for autism spectrum disorders (ASD), though there is no evidence directly implicating this gene in ASD. Increased expression of this gene has been found in lung cancers, and the protein is therefore considered to be a novel prognostic marker for lung cancer. Alternative splicing of this gene results in multiple transcript variants. [provided by RefSeq, August 2011]. Transcript Variant: This variant (1) uses an alternate in-frame splice site in the 5' coding region, compared to variant 5, resulting in an isoform (1) that is shorter than isoform 5. |
| SEZ6L2 | Y | 1307 | NM_201575 | Homo sapiens seizure related 6 homolog (mouse)-like 2 (SEZ6L2), transcript variant 2, mRNA. | This gene encodes a seizure-related protein that is localized on the cell surface. The gene is located in a region of chromosome 16p11.2 that is thought to contain candidate genes for autism spectrum disorders (ASD), though there is no evidence directly implicating this gene in ASD. Increased expression of this gene has been found in lung cancers, and the protein is therefore considered to be a novel prognostic marker for lung cancer. Alternative splicing of this gene results in multiple transcript variants. [provided by RefSeq, August 2011]. Transcript Variant: This variant (2) lacks an alternate in-frame exon in the 3' coding region, compared to variant 5, resulting in an isoform (2) that is shorter than isoform 5. |
| TAOK2 | Y | 1308 | NM_001252043 | Homo sapiens TAO kinase 2 (TAOK2), transcript variant 3, mRNA. | This gene encodes a serine/threonine protein kinase that is involved in many different processes, including, cell signaling, microtubule organization and stability, and apoptosis. Alternatively spliced transcript variants encoding different isoforms have been described for this gene. [provided by RefSeq, October 2011]. Transcript Variant: This variant (3) is alternatively spliced at the 3' end compared to variant 1. However, it maintains the reading frame, and encodes a shorter isoform (3) missing a protein segment compared to isoform 1. |
| TAOK2 | Y | 1309 | NM_004783 | Homo sapiens TAO kinase 2 (TAOK2), transcript variant 2, mRNA. | This gene encodes a serine/threonine protein kinase that is involved in many different processes, including, cell signaling, microtubule organization and stability, and apoptosis. Alternatively spliced transcript variants encoding different isoforms have been described for this gene. [provided by RefSeq, October 2011]. Transcript Variant: This variant (2) contains alternate exons at the 3' end compared to variant 1. This results in a shorter isoform (2, also known as PSK1-beta) with a distinct C-terminus compared to isoform 1. |
| TAOK2 | Y | 1310 | NM_016151 | Homo sapiens TAO kinase 2 (TAOK2), transcript variant 1, mRNA. | This gene encodes a serine/threonine protein kinase that is involved in many different processes, including, cell signaling, microtubule organization and stability, and apoptosis. Alternatively spliced transcript variants encoding different isoforms have been described for this gene. [provided by RefSeq, October 2011]. Transcript Variant: This variant (1) encodes the longest isoform (1, also known as PSK1-alpha). |
| TBX6 | Y | 1311 | NM_004608 | Homo sapiens T-box 6 (TBX6), mRNA. | This gene is a member of a phylogenetically conserved family of genes that share a common DNA-binding domain, the T-box. T-box genes encode transcription factors involved in the regulation of developmental processes. Knockout studies in mice indicate that this gene is important for specification of paraxial mesoderm structures. [provided by RefSeq, August 2008]. |
| TMEM219 | Y | 1312 | NM_001083613 | Homo sapiens transmembrane protein 219 (TMEM219), transcript variant 1, mRNA. | N/A |
| TMEM219 | Y | 1313 | NM_194280 | Homo sapiens transmembrane protein 219 (TMEM219), transcript variant 2, mRNA. | N/A |

TABLE 4-continued

| Gene name | Exon overlap | SEQ ID No | RefSeq Accession Number | mRNA Description | RefSeq Summary |
|---|---|---|---|---|---|
| YPEL3 | Y | 1314 | NM_001145524 | Homo sapiens yippee-like 3 (Drosophila) (YPEL3), transcript variant 2, mRNA. | N/A |
| YPEL3 | Y | 1315 | NM_031477 | Homo sapiens yippee-like 3 (Drosophila) (YPEL3), transcript variant 1, mRNA. | N/A |
| ZG16 | Y | 1316 | NM_152338 | Homo sapiens zymogen granule protein 16 homolog (rat) (ZG16), mRNA. | N/A |
| ABHD3 | N | 1317 | NM_138340 | Homo sapiens abhydrolase domain containing 3 (ABHD3), mRNA. | This gene encodes a protein containing an alpha/beta hydrolase fold, which is a catalytic domain found in a very wide range of enzymes. The function of this protein has not been determined. [provided by RefSeq, July 2008]. |
| RTTN | N | 1318 | NM_173630 | Homo sapiens rotatin (RTTN), mRNA. | RTTN is required for the early developmental processes of left-right (L-R) specification and axial rotation and may play a role in notochord development (Faisst et al., 2002 [PubMed 11900971]). [supplied by OMIM, March 2008]. |
| BCAS1 | N | 1319 | NM_003657 | Homo sapiens breast carcinoma amplified sequence 1 (BCAS1), mRNA. | This gene resides in a region at 20q13 which is amplified in a variety of tumor types and associated with more aggressive tumor phenotypes. Among the genes identified from this region, it was found to be highly expressed in three amplified breast cancer cell lines and in one breast tumor without amplification at 20q13.2. However, this gene is not in the common region of maximal amplification and its expression was not detected in the breast cancer cell line MCF7, in which this region is highly amplified. Although not consistently expressed, this gene is a candidate oncogene. [provided by RefSeq, July 2008]. Sequence Note: The RefSeq transcript and protein were derived from genomic sequence to make the sequence consistent with the reference genome assembly. The genomic coordinates used for the transcript record were based on alignments. |
| HAR1A | Y | 1320 | NR_003244 | Homo sapiens highly accelerated region 1A (non-protein coding) (HAR1A), non-coding RNA. | N/A |
| HAR1B | Y | 1321 | NR_003245 | Homo sapiens highly accelerated region 1B (non-protein coding) (HAR1B), non-coding RNA. | N/A |
| LOC63930 | N | 1322 | NR_033370 | Homo sapiens uncharacterized LOC63930 (LOC63930), non-coding RNA. | N/A |
| LOC63930 | Y | 1322 | NR_033370 | Homo sapiens uncharacterized LOC63930 (LOC63930), non-coding RNA. | N/A |
| MCM5 | Y | 1323 | NM_006739 | Homo sapiens minichromosome maintenance complex component 5 (MCM5), mRNA. | The protein encoded by this gene is structurally very similar to the CDC46 protein from S. cerevisiae, a protein involved in the initiation of DNA replication. The encoded protein is a member of the MCM family of chromatin-binding proteins and can interact with at least two other members of this family. The encoded protein is upregulated in the transition from the G0 to G1/S phase of the cell cycle and may actively participate in cell cycle regulation. [provided by RefSeq, July 2008]. |
| APOO | Y | 1324 | NM_024122 | Homo sapiens apolipoprotein O (APOO), transcript variant 1, mRNA. | This gene is a member of the apolipoprotein family. Members of this protein family are involved in the transport and metabolism of lipids. The encoded protein associates with HDL, LDL and VLDL lipoproteins and is characterized by chondroitin-sulfate glycosylation. This protein may be involved in preventing lipid accumulation in the myocardium in obese and diabetic patients. Alternative splicing |

TABLE 4-continued

| Gene name | Exon overlap | SEQ ID No | RefSeq Accession Number | mRNA Description | RefSeq Summary |
|---|---|---|---|---|---|
| APOO | Y | 1325 | NR_026545 | *Homo sapiens* apolipoprotein O (APOO), transcript variant 2, non-coding RNA. | results in multiple transcript variants. Pseudogenes of this gene are found on chromosomes 3, 4, 5, 12 and 16. [provided by RefSeq, September 2009]. Transcript Variant: This variant (1) represents the longer transcript and is predicted to encode the functional protein. This gene is a member of the apolipoprotein family. Members of this protein family are involved in the transport and metabolism of lipids. The encoded protein associates with HDL, LDL and VLDL lipoproteins and is characterized by chondroitin-sulfate glycosylation. This protein may be involved in preventing lipid accumulation in the myocardium in obese and diabetic patients. Alternative splicing results in multiple transcript variants. Pseudogenes of this gene are found on chromosomes 3, 4, 5, 12 and 16. [provided by RefSeq, September 2009]. Transcript Variant: This variant (2) omits a coding exon resulting in a frameshift and premature stop codon. The transcript is likely non-coding because it is a candidate for nonsense-mediated decay (NMD); therefore, the truncated protein is not annotated. Sequence Note: This RefSeq record was created from transcript and genomic sequence data to make the sequence consistent with the reference genome assembly. The genomic coordinates used for the transcript record were based on transcript alignments. |
| ARSF | Y | 1326 | NM_001201538 | *Homo sapiens* arylsulfatase F (ARSF), transcript variant 2, mRNA. | This gene is a member of the sulfatase family, and more specifically, the arylsulfatase subfamily. Members of the subfamily share similarity in sequence and splice sites, and are clustered together on chromosome X, suggesting that they are derived from recent gene duplication events. Sulfatases are essential for the correct composition of bone and cartilage matrix. The activity of this protein, unlike that of arylsulfatase E, is not inhibited by warfarin. Multiple alternatively spliced variants, encoding the same protein, have been identified. [provided by RefSeq, January 2011]. Transcript Variant: This variant (2) differs in the 5′ UTR compared to variant 1. Variants 1, 2 and 3 encode the same protein. Sequence Note: This RefSeq record was created from transcript and genomic sequence data to make the sequence consistent with the reference genome assembly. The genomic coordinates used for the transcript record were based on transcript alignments. |
| ARSF | Y | 1327 | NM_001201539 | *Homo sapiens* arylsulfatase F (ARSF), transcript variant 3, mRNA. | This gene is a member of the sulfatase family, and more specifically, the arylsulfatase subfamily. Members of the subfamily share similarity in sequence and splice sites, and are clustered together on chromosome X, suggesting that they are derived from recent gene duplication events. Sulfatases are essential for the correct composition of bone and cartilage matrix. The activity of this protein, unlike that of arylsulfatase E, is not inhibited by warfarin. Multiple alternatively spliced variants, encoding the same protein, have been identified. [provided by RefSeq, January 2011]. Transcript Variant: This variant (3) differs in the 5′ UTR compared to variant 1. Variants 1, 2 and 3 encode the same protein. Sequence Note: This RefSeq record was created from transcript and genomic sequence data to make the sequence consistent with the reference genome assembly. The genomic coordinates used for the transcript record were based on transcript alignments. |
| ARSF | Y | 1328 | NM_004042 | *Homo sapiens* arylsulfatase F (ARSF), transcript variant 1, mRNA. | This gene is a member of the sulfatase family, and more specifically, the arylsulfatase subfamily. Members of the subfamily share similarity in sequence and splice sites, and are clustered together on chromosome X, suggesting that they are derived from recent gene duplication events. Sulfatases are essential for the correct composition of bone and cartilage matrix. The activity of this protein, unlike that of arylsulfatase E, is not inhibited by warfarin. Multiple alternatively spliced variants, encoding the same protein, have been identified. [provided by RefSeq, January 2011]. Transcript Variant: This variant (1) represents the shortest variant. Variants 1, 2 and 3 encode the same protein. Sequence Note: This RefSeq record was created from transcript and genomic sequence data to make the sequence consistent with the reference genome assembly. The genomic coordinates used for the transcript record were based on transcript alignments. |
| CA5BP1 | Y | 1329 | NR_026551 | *Homo sapiens* carbonic anhydrase VB pseudogene 1 (CA5BP1), non-coding RNA. | N/A |

TABLE 4-continued

| Gene name | Exon overlap | SEQ ID No | RefSeq Accession Number | mRNA Description | RefSeq Summary |
|---|---|---|---|---|---|
| DDX53 | Y | 1330 | NM_182699 | *Homo sapiens* DEAD (Asp-Glu-Ala-Asp) box polypeptide 53 (DDX53), mRNA. | This intronless gene encodes a protein which contains several domains found in members of the DEAD-box helicase protein family. Other members of this protein family participate in ATP-dependent RNA unwinding. [provided by RefSeq, September 2011]. |
| DMD | Y | 1331 | NM_000109 | *Homo sapiens* dystrophin (DMD), transcript variant Dp427c, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: transcript Dp427c is expressed predominantly in neurons of the cortex and the CA regions of the hippocampus. It uses a unique promoter/exon 1 located about 130 kb upstream of the Dp427m transcript promoter. The transcript includes the common exon 2 of transcript Dp427m and has a similar length of 14 kb. The Dp427c isoform contains a unique N-terminal MED sequence, instead of the MLWWEEVEDCY sequence of isoform Dp427m. The remainder of isoform Dp427c is identical to isoform Dp427m. Sequence Note: This RefSeq record was created from transcript and genomic sequence data to make the sequence consistent with the reference genome assembly. The genomic coordinates used for the transcript record were based on transcript alignments. |
| DMD | Y | 1332 | NM_004006 | *Homo sapiens* dystrophin (DMD), transcript variant Dp427m, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: transcript Dp427m encodes the main dystrophin protein found in muscle. As a result of alternative promoter use, exon 1 encodes a unique N-terminal MLWWEEVEDCY aa sequence. Sequence Note: This RefSeq record was created from transcript and genomic sequence data to make the sequence consistent with the reference genome assembly. The genomic coordinates used for the transcript record were based on transcript alignments. |
| DMD | Y | 1333 | NM_004007 | *Homo sapiens* dystrophin (DMD), transcript variant Dp427l, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least |

TABLE 4-continued

| Gene name | Exon overlap | SEQ ID No | RefSeq Accession Number | mRNA Description | RefSeq Summary |
|---|---|---|---|---|---|
| | | | | | eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: transcript Dp427l originates at a unique promoter/exon 1 with splicing to exon 3 of the full length dystrophin (Dp427m) transcript. Consequently, amino acids 1-31 are replaced by a single methionine. Sequence Note: This RefSeq record was created from transcript and genomic sequence data to make the sequence consistent with the reference genome assembly. The genomic coordinates used for the transcript record were based on transcript alignments. |
| DMD | Y | 1334 | NM_004009 | *Homo sapiens* dystrophin (DMD), transcript variant Dp427p1, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: transcript Dp427p1 initiates from a unique promoter/exon 1 located in what corresponds to the first intron of transcript Dp427m. The transcript adds the common exon 2 of Dp427m and has a similar length (14 kb). The Dp427p1 isoform replaces the MLWWEEVEDCY-start of Dp427m with a unique N-terminal MSEVSSD aa sequence. Sequence Note: This RefSeq record was created from transcript and genomic sequence data to make the sequence consistent with the reference genome assembly. The genomic coordinates used for the transcript record were based on transcript alignments. |
| DMD | Y | 1335 | NM_004010 | *Homo sapiens* dystrophin (DMD), transcript variant Dp427p2, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: transcript Dp427p2 has an additional 82 nt directly after exon 1 which introduces a translational stop codon 24 bp downstream of the same ATG codon included in the Dp427p1 transcript. This transcript has unknown coding capacity. Sequence Note: This RefSeq record was created from transcript and genomic sequence data to make the sequence consistent with the reference genome assembly. The genomic coordinates used for the transcript record were based on transcript alignments. |

TABLE 4-continued

| Gene name | Exon overlap | SEQ ID No | RefSeq Accession Number | mRNA Description | RefSeq Summary |
|---|---|---|---|---|---|
| DMD | Y | 1336 | NM_004011 | *Homo sapiens* dystrophin (DMD), transcript variant Dp260-1, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: transcript Dp260-1 uses exons 30-79, and originates from a promoter/exon 1 sequence located in intron 29 of the dystrophin gene. As a result, Dp260-1 contains a 95 bp exon 1 encoding N-terminal 16 aa MTEIILLIFFPAYFLN-sequence that replaces amino acids 1-1357 of the full-length dystrophin product (Dp427m isoform). Sequence Note: This RefSeq record was created from transcript and genomic sequence data to make the sequence consistent with the reference genome assembly. The genomic coordinates used for the transcript record were based on transcript alignments. |
| DMD | Y | 1337 | NM_004012 | *Homo sapiens* dystrophin (DMD), transcript variant Dp260-2, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: transcript Dp260-2 uses exons 30-79, starting from a promoter/exon 1 sequence located in intron 29 of the full length dystrophin (Dp427m isoform). The Dp260-2 transcript encodes a unique N-terminal MSARKLRNLSYKK sequence. Sequence Note: This RefSeq record was created from transcript and genomic sequence data to make the sequence consistent with the reference genome assembly. The genomic coordinates used for the transcript record were based on transcript alignments. |
| DMD | Y | 1338 | NM_004013 | *Homo sapiens* dystrophin (DMD), transcript variant Dp140, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein |

TABLE 4-continued

| Gene name | Exon overlap | SEQ ID No | RefSeq Accession Number | mRNA Description | RefSeq Summary |
|---|---|---|---|---|---|
| | | | | | complex (DGC), which bridges the inner cytoskeleton (F-actin) and the extra-cellular matrix. [provided by RefSeq, July 2008]. Transcript Variant: Dp140 transcripts use exons 45-79, starting at a promoter/exon 1 located in intron 44. Dp140 transcripts have a long (1 kb) 5' UTR since translation is initiated in exon 51 (corresponding to aa 2461 of dystrophin). In addition to the alternative promoter and exon 1, differential splicing of exons 71-74 and 78 produces at least five Dp140 isoforms. Of these, this transcript (Dp140) contains all of the exons. |
| DMD | Y | 1339 | NM_004014 | *Homo sapiens* dystrophin (DMD), transcript variant Dp116, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: transcript Dp116 uses exons 56-79, starting from a promoter/exon 1 within intron 55. As a result, the Dp116 isoform contains a unique N-terminal MLHRKTYHVK aa sequence, instead of aa 1-2739 of dystrophin. Differential splicing produces several Dp116-subtypes. The Dp116 isoform is also known as S-dystrophin or apo-dystrophin-2. Sequence Note: This RefSeq record was created from transcript and genomic sequence data to make the sequence consistent with the reference genome assembly. The genomic coordinates used for the transcript record were based on transcript alignments. |
| DMD | Y | 1340 | NM_004015 | *Homo sapiens* dystrophin (DMD), transcript variant Dp71, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: Dp71 transcripts use exons 63-79 with a novel 80- to 100-nt exon containing an ATG start site for a new coding sequence of 17 nt. The short coding sequence is in-frame with the consecutive dystrophin sequence from exon 63. Differential splicing of exons 71 and 78 produces at least four Dp71 isoforms. Of these, this transcript (Dp71) includes both exons 71 and 78. |
| DMD | Y | 1341 | NM_004016 | *Homo sapiens* dystrophin (DMD), transcript variant Dp71b, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least |

TABLE 4-continued

| Gene name | Exon overlap | SEQ ID No | RefSeq Accession Number | mRNA Description | RefSeq Summary |
|---|---|---|---|---|---|
| DMD | | | | | eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: Dp71 transcripts use exons 63-79 with a novel 80- to 100-nt exon containing an ATG start site for a new coding sequence of 17 nt. The short coding sequence is in-frame with the consecutive dystrophin sequence from exon 63. Differential splicing of exons 71 and 78 produces at least four Dp71 isoforms. Of these, this transcript (Dp71b) lacks exon 78 and encodes a protein with a different C-terminus than Dp71 and Dp71a isoforms. |
| DMD | Y | 1342 | NM_004017 | Homo sapiens dystrophin (DMD), transcript variant Dp71a, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: Dp71 transcripts use exons 63-79 with a novel 80- to 100-nt exon containing an ATG start site for a new coding sequence of 17 nt. The short coding sequence is in-frame with the consecutive dystrophin sequence from exon 63. Differential splicing of exons 71 and 78 produces at least four Dp71 isoforms. Of these, this transcript (Dp71a)lacks exon 71. |
| DMD | Y | 1343 | NM_004018 | Homo sapiens dystrophin (DMD), transcript variant Dp71ab, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: Dp71 transcripts use exons 63-79 with a novel 80- to 100-nt exon containing an ATG start site for a new coding sequence of 17 nt. The short coding sequence is in-frame with the consecutive dystrophin sequence from exon 63. Differential splicing of exons 71 and 78 produces at least four Dp71 isoforms. Of these, this transcript (Dp71ab) lacks both exons 71 and 78 and encodes a protein with a C-terminus like isoform Dp71b. |
| DMD | Y | 1344 | NM_004019 | Homo sapiens dystrophin (DMD), transcript variant Dp40, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in- |

TABLE 4-continued

| Gene name | Exon overlap | SEQ ID No | RefSeq Accession Number | mRNA Description | RefSeq Summary |
|---|---|---|---|---|---|
| | | | | | frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: transcript Dp40 uses exons 63-70. The 5′ UTR and encoded first 7 aa are identical to that in transcript Dp71, but the stop codon lies at the splice junction of the exon/intron 70. The 3′ UTR includes at from intron 70 which includes an alternative polyadenylation site. The Dp40 isoform lacks the normal C-terminal end of full-length dystrophin (aa 3409-3685). |
| DMD | Y | 1345 | NM_004020 | Homo sapiens dystrophin (DMD), transcript variant Dp140c, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: Dp140 transcripts use exons 45-79, starting at a promoter/exon 1 located in intron 44. Dp140 transcripts have a long (1 kb) 5′ UTR since translation is initiated in exon 51 (corresponding to aa 2461 of dystrophin). In addition to the alternative promoter and exon 1, differential splicing of exons 71-74 and 78 produces at least five Dp140 isoforms. Of these, this transcript (Dp140c) lacks exons 71-74. Sequence Note: This RefSeq record was created from transcript and genomic sequence data to make the sequence consistent with the reference genome assembly. The genomic coordinates used for the transcript record were based on transcript alignments. |
| DMD | Y | 1346 | NM_004021 | Homo sapiens dystrophin (DMD), transcript variant Dp140b, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: Dp140 transcripts use exons 45-79, starting at a promoter/exon 1 located in intron 44. Dp140 transcripts have a long (1 kb) 5′ UTR since translation is initiated in exon 51 (corresponding to aa 2461 of dystrophin). In addition to the alternative promoter and exon 1, differential splicing of exons 71-74 and 78 produces at least five Dp140 isoforms. Of these, this transcript (Dp140b) lacks exon 78 and encodes a protein with a unique C-terminus. |

TABLE 4-continued

| Gene name | SEQ ID No | RefSeq Accession Number | Exon overlap | mRNA Description | RefSeq Summary |
|---|---|---|---|---|---|
| DMD | 1347 | NM_004022 | Y | Homo sapiens dystrophin (DMD), transcript variant Dp140qb, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: Dp140 transcripts use exons 45-79, starting at a promoter/exon 1 located in intron 44. Dp140 transcripts have a long (1 kb) 5' UTR since translation is initiated in exon 51 (corresponding to aa 2461 of dystrophin). In addition to the alternative promoter and exon 1, differential splicing of exons 71-74 and 78 produces at least five Dp140 isoforms. Of these, this transcript (Dp140ab) lacks exons 71 and 78 and encodes a protein with a unique C-terminus. |
| DMD | 1348 | NM_004023 | Y | Homo sapiens dystrophin (DMD), transcript variant Dp140bc, mRNA. | The dystrophin gene is the largest gene found in nature, measuring 2.4 Mb. The gene was identified through a positional cloning approach, targeted at the isolation of the gene responsible for Duchenne (DMD) and Becker (BMD) Muscular Dystrophies. DMD is a recessive, fatal, X-linked disorder occurring at a frequency of about 1 in 3,500 new-born males. BMD is a milder allelic form. In general, DMD patients carry mutations which cause premature translation termination (nonsense or frame shift mutations), while in BMD patients dystrophin is reduced either in molecular weight (derived from in-frame deletions) or in expression level. The dystrophin gene is highly complex, containing at least eight independent, tissue-specific promoters and two polyA-addition sites. Furthermore, dystrophin RNA is differentially spliced, producing a range of different transcripts, encoding a large set of protein isoforms. Dystrophin (as encoded by the Dp427 transcripts) is a large, rod-like cytoskeletal protein which is found at the inner surface of muscle fibers. Dystrophin is part of the dystrophin-glycoprotein complex (DGC), which bridges the inner cytoskeleton (F-actin) and the extra-cellular matrix. [provided by RefSeq, July 2008]. Transcript Variant: Dp140 transcripts use exons 45-79, starting at a promoter/exon 1 located in intron 44. Dp140 transcripts have a long (1 kb) 5' UTR since translation is initiated in exon 51 (corresponding to aa 2461 of dystrophin). In addition to the alternative promoter and exon 1, differential splicing of exons 71-74 and 78 produces at least five Dp140 isoforms. Of these, this transcript (Dp140bc) lacks exons 71-74 and 78 and encodes a protein with a unique C-terminus. |
| NLGN4X | 1349 | NM_020742 | Y | Homo sapiens neuroligin 4, X-linked (NLGN4X), transcript variant 1, mRNA. | This gene encodes a member of a family of neuronal cell surface proteins. Members of this family may act as splice site-specific ligands for beta-neurexins and may be involved in the formation and remodeling of central nervous system synapses. The encoded protein interacts with discs, large (Drosophila) homolog 4 (DLG4). Mutations in this gene have been associated with autism and Asperger syndrome. Two transcript variants encoding the same protein have been identified for this gene. [provided by RefSeq, July 2008]. Transcript Variant: This variant (1) represents the longer transcript. Variants 1 and 2 encode the same isoform. |
| NLGN4X | 1350 | NM_181332 | Y | Homo sapiens neuroligin 4, X-linked (NLGN4X), transcript variant 2, mRNA. | This gene encodes a member of a family of neuronal cell surface proteins. Members of this family may act as splice site-specific ligands for beta-neurexins and may be involved in the formation and remodeling of central nervous system synapses. The encoded protein interacts with discs, large (Drosophila) homolog 4 (DLG4). Mutations in this gene have been associated with autism and Asperger syndrome. Two transcript variants encoding the same protein have been identified for this gene. [provided by RefSeq, July 2008]. Transcript Variant: This variant (2) differs in the 5' UTR compared to variant 1. Variants 1 and 2 encode the same isoform. |

TABLE 4-continued

| Gene name | Exon overlap | SEQ ID No | RefSeq Accession Number | mRNA Description | RefSeq Summary |
|---|---|---|---|---|---|
| TMEM27 | Y | 1351 | NM_020665 | *Homo sapiens* transmembrane protein 27 (TMEM27), mRNA. | This gene encodes a transmembrane protein that is important for trafficking amino acid transporters to the apical brush border of proximal tubules. It also plays a role in controlling insulin exocytosis by regulating formation of the SNARE (soluble N-ethylmaleimide-sensitive-factor attachment protein receptor) complex in pancreatic beta cells. [provided by RefSeq, November 2009]. |
| XG | Y | 1352 | NM_001141919 | *Homo sapiens* Xg blood group (XG), transcript variant 2, mRNA. | This gene encodes the XG blood group antigen. The three 5' exons reside at the pseudoautosomal boundary on the short (p) arm of chromosome X. The three 5' exons reside in the pseudoautosomal region and the remaining exons within the X-specific end. A truncated copy of this gene is found on the Y chromosome at the pseudoautosomal boundary. It is transcribed, but not expected to make a Y-chromosome specific gene product. Alternatively spliced transcript variants encoding different isoforms have been found for this gene. [provided by RefSeq, November 2008]. Transcript Variant: This variant (2) contains an additional in-frame coding exon compared to transcript variant 1. This results in a longer isoform (2) with a 15 aa segment not found in isoform 1. Sequence Note: This RefSeq record was created from transcript and genomic sequence data because no quality transcript was available for the full length of the gene. The extent of this transcript is supported by transcript alignments. |
| XG | Y | 1353 | NM_001141920 | *Homo sapiens* Xg blood group (XG), transcript variant 3, mRNA. | This gene encodes the XG blood group antigen, and is located at the pseudoautosomal boundary on the short (p) arm of chromosome X. The three 5' exons reside in the pseudoautosomal region and the remaining exons within the X-specific end. A truncated copy of this gene is found on the Y chromosome at the pseudoautosomal boundary. It is transcribed, but not expected to make a Y-chromosome specific gene product. Alternatively spliced transcript variants encoding different isoforms have been found for this gene. [provided by RefSeq, November 2008]. Transcript Variant: This variant (3) uses an alternate donor splice site at one of the coding exons compared to transcript variant 1, resulting in an isoform (3) containing one additional aa compared to isoform 1. Sequence Note: This RefSeq record was created from transcript and genomic sequence data because no quality transcript was available for the full length of the gene. The extent of this transcript is supported by transcript alignments. Sequence Note: This RefSeq record represents the XG*001.1.1 allele. |
| XG | Y | 1354 | NM_175569 | *Homo sapiens* Xg blood group (XG), transcript variant 1, mRNA. | This gene encodes the XG blood group antigen, and is located at the pseudoautosomal boundary on the short (p) arm of chromosome X. The three 5' exons reside in the pseudoautosomal region and the remaining exons within the X-specific end. A truncated copy of this gene is found on the Y chromosome at the pseudoautosomal boundary. It is transcribed, but not expected to make a Y-chromosome specific gene product. Alternatively spliced transcript variants encoding different isoforms have been found for this gene. [provided by RefSeq, November 2008]. Transcript Variant: This variant (1) represents the predominant transcript and encodes isoform 1. Sequence Note: This RefSeq record was created from transcript and genomic sequence data because no quality transcript was available for the full length of the gene. The extent of this transcript is supported by transcript alignments. Sequence Note: This RefSeq record represents the XG*001.1.1 allele. |
| SEMA3F | both | 1355 | NM_004186 | *Homo sapiens* sema domain, immunoglobulin domain (Ig), short basic domain, secreted, (semaphorin) 3F SEMA3F), mRNA. | The semaphorins are a family of proteins that are involved in signaling. All the family members have a secretion signal, a 500-amino acid sema domain, and 16 conserved cysteine residues (Kolodkin et al., 1993 [PubMed 8269517]). Sequence comparisons have grouped the secreted semaphorins into 3 general classes, all of which also have an immunoglobulin domain. The semaphorin III family, (consisting of human semaphorin III (SEMA3A; MIM 603961), chicken collapsin, and mouse semaphorins A, D, and E, all have a basic domain at the C terminus. Chicken collapsin contributes to path finding by axons during development by inhibiting extension of growth cones (Luo et al., 1993 [PubMed 8402908]) through an interaction with a collapsin response mediator protein of relative molecular mass 62K (CRMP62) (Goshima et al., 1995 [PubMed 7637782]), a putative homolog of an axonal guidance associated UNC33 gene product (MIM 601168). SEMA3F is a secreted member of the semaphorin III family. [supplied by OMIM, March 2008]. |
| AMY2B | N | 1356 | NM_020978 | *Homo sapiens* amylase, alpha 2B (pancreatic) (AMY2B), mRNA. | Amylases are secreted proteins that hydrolyze 1,4-alpha-glucoside bonds in oligosaccharides and polysaccharides, and thus catalyze the first step in digestion of dietary starch and glycogen. The human genome has a cluster of several amylase genes that are expressed at high levels in either salivary gland |

TABLE 4-continued

| Gene name | Exon overlap | SEQ ID No | RefSeq Accession Number | mRNA Description | RefSeq Summary |
|---|---|---|---|---|---|
| FAM5C | N | 1357 | NM_199051 | *Homo sapiens* family with sequence similarity 5, member C (FAM5C), mRNA. | or pancreas. This gene encodes an amylase isoenzyme produced by the pancreas. [provided by RefSeq, July 2008]. |
| ZC3H6 | N | 1358 | NM_198581 | *Homo sapiens* zinc finger CCCH-type containing 6 (ZC3H6), mRNA. | N/A |
| PDE11A | N | 1359 | NM_001077196 | *Homo sapiens* phosphodiesterase 11A (PDE11A), transcript variant 1, mRNA. | The 3′,5′-cyclic nucleotides cAMP and cGMP function as second messengers in a wide variety of signal transduction pathways. 3′,5′-cyclic nucleotide phosphodiesterases (PDEs) catalyze the hydrolysis of cAMP and cGMP to the corresponding 5′-monophosphates and provide a mechanism to downregulate cAMP and cGMP signaling. This gene encodes a member of the PDE protein superfamily. Mutations in this gene are a cause of Cushing disease and adrenocortical hyperplasia. Multiple transcript variants encoding different isoforms have been found for this gene. [provided by RefSeq, July 2008]. Transcript Variant: This variant (1) contains a distinct 5′ UTR and lacks an in-frame portion of the 5′ coding region, compared to variant 4. The resulting isoform (1) has a shorter N-terminus, compared to isoform 4. |
| PDE11A | N | 1360 | NM_001077197 | *Homo sapiens* phosphodiesterase 11A (PDE11A), transcript variant 3, mRNA. | The 3′,5′-cyclic nucleotides cAMP and cGMP function as second messengers in a wide variety of signal transduction pathways. 3′,5′-cyclic nucleotide phosphodiesterases (PDEs) catalyze the hydrolysis of cAMP and cGMP to the corresponding 5′-monophosphates and provide a mechanism to downregulate cAMP and cGMP signaling. This gene encodes a member of the PDE protein superfamily. Mutations in this gene are a cause of Cushing disease and adrenocortical hyperplasia. Multiple transcript variants encoding different isoforms have been found for this gene. [provided by RefSeq, July 2008]. Transcript Variant: This variant (3) contains a distinct 5′ UTR and 5′ coding region, compared to variant 4. The resulting isoform (3) contains a shorter and distinct N-terminus, compared to isoform 4. |
| PDE11A | N | 1361 | NM_001077358 | *Homo sapiens* phosphodiesterase 11A (PDE11A), transcript variant 2, mRNA. | The 3′,5′-cyclic nucleotides cAMP and cGMP function as second messengers in a wide variety of signal transduction pathways. 3′,5′-cyclic nucleotide phosphodiesterases (PDEs) catalyze the hydrolysis of cAMP and cGMP to the corresponding 5′-monophosphates and provide a mechanism to downregulate cAMP and cGMP signaling. This gene encodes a member of the PDE protein superfamily. Mutations in this gene are a cause of Cushing disease and adrenocortical hyperplasia. Multiple transcript variants encoding different isoforms have been found for this gene. [provided by RefSeq, July 2008]. Transcript Variant: This variant (2) contains a distinct 5′ UTR and lacks an in-frame portion of the 5′ coding region, compared to variant 4. The resulting isoform (2) has a shorter N-terminus, compared to isoform 4. |
| PDE11A | N | 1362 | NM_016953 | *Homo sapiens* phosphodiesterase 11A (PDE11A), transcript variant 4, mRNA. | The 3′,5′-cyclic nucleotides cAMP and cGMP function as second messengers in a wide variety of signal transduction pathways. 3′,5′-cyclic nucleotide phosphodiesterases (PDEs) catalyze the hydrolysis of cAMP and cGMP to the corresponding 5′-monophosphates and provide a mechanism to downregulate cAMP and cGMP signaling. This gene encodes a member of the PDE protein superfamily. Mutations in this gene are a cause of Cushing disease and adrenocortical hyperplasia. Multiple transcript variants encoding different isoforms have been found for this gene. [provided by RefSeq, July 2008]. Transcript Variant: This variant (4) represents the longest transcript and encodes the longest isoform (4). |
| SPAG16 | N | 1363 | NM_001025436 | *Homo sapiens* sperm associated antigen 16 (SPAG16), transcript variant 2, mRNA. | Cilia and flagella are comprised of a microtubular backbone, the axoneme, which is organized by the basal body and surrounded by plasma membrane. SPAG16 encodes 2 major proteins that associate with the axoneme of sperm tail and the nucleus of postmeiotic germ cells, respectively (Zhang et al., 2007 [PubMed 17699735]). [supplied by OMIM, July 2008]. |

TABLE 4-continued

| Gene name | Exon overlap | SEQ ID No | RefSeq Accession Number | mRNA Description | RefSeq Summary |
|---|---|---|---|---|---|
| SPAG16 | N | 1364 | NM_024532 | *Homo sapiens* sperm associated antigen 16 (SPAG16), transcript variant 1, mRNA. | Cilia and flagella are comprised of a microtubular backbone, the axoneme, which is organized by the basal body and surrounded by plasma membrane. SPAG16 encodes 2 major proteins that associate with the axoneme of sperm tail and the nucleus of postmeiotic germ cells, respectively (Zhang et al., 2007 [PubMed 17699735]). [supplied by OMIM, July 2008]. |
| PDCD6IP | N | 1365 | NM_001162429 | *Homo sapiens* programmed cell death 6 interacting protein (PDCD6IP), transcript variant 2, mRNA. | This gene encodes a protein thought to participate in programmed cell death. Studies using mouse cells have shown that overexpression of this protein can block apoptosis. In addition, the product of this gene binds to the product of the PDCD6 gene, a protein required for apoptosis, in a calcium-dependent manner. This gene product also binds to endophilins, proteins that regulate membrane shape during endocytosis. Overexpression of this gene product and endophilins results in cytoplasmic vacuolization, which may be partly responsible for the protection against cell death. Several alternatively spliced transcript variants encoding different isoforms have been found for this gene. [provided by RefSeq, June 2009]. Transcript Variant: This variant (2) uses an alternative in-frame acceptor splice site at an internal coding exon compared to variant 1. This results in an isoform (2) 5 aa longer than isoform 1. |
| PDCD6IP | N | 1366 | NM_013374 | *Homo sapiens* programmed cell death 6 interacting protein (PDCD6IP), transcript variant 1, mRNA. | This gene encodes a protein thought to participate in programmed cell death. Studies using mouse cells have shown that overexpression of this protein can block apoptosis. In addition, the product of this gene binds to the product of the PDCD6 gene, a protein required for apoptosis, in a calcium-dependent manner. This gene product also binds to endophilins, proteins that regulate membrane shape during endocytosis. Overexpression of this gene product and endophilins results in cytoplasmic vacuolization, which may be partly responsible for the protection against cell death. Several alternatively spliced transcript variants encoding different isoforms have been found for this gene. [provided by RefSeq, June 2009]. Transcript Variant: This variant (1) represents the predominant transcript and encodes isoform 1. |
| PDCD6IP | N | 1367 | NR_028767 | *Homo sapiens* programmed cell death 6 interacting protein (PDCD6IP), transcript variant 3, non-coding RNA. | This gene encodes a protein thought to participate in programmed cell death. Studies using mouse cells have shown that overexpression of this protein can block apoptosis. In addition, the product of this gene binds to the product of the PDCD6 gene, a protein required for apoptosis, in a calcium-dependent manner. This gene product also binds to endophilins, proteins that regulate membrane shape during endocytosis. Overexpression of this gene product and endophilins results in cytoplasmic vacuolization, which may be partly responsible for the protection against cell death. Several alternatively spliced transcript variants encoding different isoforms have been found for this gene. [provided by RefSeq, June 2009]. Transcript Variant: This variant (3) uses an alternate promoter, and is missing several coding exons from the 5' end compared to variant 1. It is represented as non-coding because it lacks a large portion of the N-terminal coding region, which includes the BRO1-like domain. Publication Note: This RefSeq record includes a subset of the publications that are available for this gene. Please see the Gene record to access additional publications. |
| PDCD6IP | N | 1368 | NR_027868 | *Homo sapiens* programmed cell death 6 interacting protein (PDCD6IP), transcript variant 4, non-coding RNA. | This gene encodes a protein thought to participate in programmed cell death. Studies using mouse cells have shown that overexpression of this protein can block apoptosis. In addition, the product of this gene binds to the product of the PDCD6 gene, a protein required for apoptosis, in a calcium-dependent manner. This gene product also binds to endophilins, proteins that regulate membrane shape during endocytosis. Overexpression of this gene product and endophilins results in cytoplasmic vacuolization, which may be partly responsible for the protection against cell death. Several alternatively spliced transcript variants encoding different isoforms have been found for this gene. [provided by RefSeq, June 2009]. Transcript Variant: This variant (4) contains a different 3' terminal exon, and is missing several coding exons from the 3' end compared to variant 1. It is represented as non-coding because it lacks a large portion of the C-terminal coding region, and the BRO1-like domain at the N-terminus is truncated. Publication Note: This RefSeq record includes a subset of the publications that are available for this gene. Please see the Gene record to access additional publications. |

TABLE 4-continued

| Gene name | Exon overlap | SEQ ID No | RefSeq Accession Number | mRNA Description | RefSeq Summary |
|---|---|---|---|---|---|
| XYLB | both | 1369 | NM_005108 | Homo sapiens xylulokinase homolog (H. influenzae) (XYLB), mRNA. | The protein encoded by this gene shares 22% sequence identity with Hemophilus influenzae xylulokinase, and even higher identity to other gene products in C. elegans (45%) and yeast (31-35%), which are thought to belong to a family of enzymes that include fucokinase, gluconokinase, glycerokinase and xylulokinase. These proteins play important roles in energy metabolism. [provided by RefSeq, August 2009]. |
| HHATL | Y | 1370 | NM_020707 | Homo sapiens hedgehog acyltransferase-like (HHATL), transcript variant 1, mRNA. | N/A |
| HHATL | Y | 1371 | NR_027753 | Homo sapiens hedgehog acyltransferase-like (HHATL), transcript variant 2, non-coding RNA. | N/A |
| SUCLG2 | N | 1372 | NM_001177599 | Homo sapiens succinate-CoA ligase, GDP-forming, beta subunit (SUCLG2), nuclear gene encoding mitochondrial protein, transcript variant 1, mRNA. | This gene encodes a GTP-specific beta subunit of succinyl-CoA synthetase. Succinyl-CoA synthetase catalyzes the reversible reaction involving the formation of succinyl-CoA and succinate. Alternate splicing results in multiple transcript variants. Pseudogenes of this gene are found on chromosomes 5 and 12. [provided by RefSeq, April 2010]. Transcript Variant: This variant (1) encodes the longer isoform (1). |
| SUCLG2 | N | 1373 | NM_003848 | Homo sapiens succinate-CoA ligase, GDP-forming, beta subunit (SUCLG2), nuclear gene encoding mitochondrial protein, transcript variant 2, mRNA. | This gene encodes a GTP-specific beta subunit of succinyl-CoA synthetase. Succinyl-CoA synthetase catalyzes the reversible reaction involving the formation of succinyl-CoA and succinate. Alternate splicing results in multiple transcript variants. Pseudogenes of this gene are found on chromosomes 5 and 12. [provided by RefSeq, April 2010]. Transcript Variant: This variant (2) differs in the 3' UTR, and 3' coding region, compared to variant 1. The encoded isoform (2) is shorter and has a distinct C-terminus, compared to isoform 1. |
| PLCH1 | N | 1374 | NM_001130960 | Homo sapiens phospholipase C, eta 1 (PLCH1) transcript variant 1, mRNA. | PLCH1 is a member of the PLC-eta family of the phosphoinositide-specific phospholipase C (PLC) superfamily of enzymes that cleave phosphatidylinositol 4,5-bisphosphate (PtdIns(4,5)P2) to generate second messengers inositol 1,4,5-trisphosphate (IP3) and diacylglycerol (DAG) (Hwang et al., 2005 [PubMed 15702972]). [supplied by OMIM, June 2009]. Transcript Variant: This variant (1) encodes the longest isoform (a). |
| PLCH1 | N | 1375 | NM_001130961 | Homo sapiens phospholipase C, eta 1 (PLCH1) transcript variant 3, mRNA. | PLCH1 is a member of the PLC-eta family of the phosphoinositide-specific phospholipase C (PLC) superfamily of enzymes that cleave phosphatidylinositol 4,5-bisphosphate (PtdIns(4,5)P2) to generate second messengers inositol 1,4,5-trisphosphate (IP3) and diacylglycerol (DAG) (Hwang et al., 2005 [PubMed 15702972]). [supplied by OMIM, June 2009]. Transcript Variant: This variant (3) has an alternate exon in the 3' end of the coding sequence compared to variant 1. This exon contains an in-frame stop codon, resulting in an isoform (c) that has a shorter and distinct C-terminus compared to isoform a. |
| PLCH1 | N | 1376 | NM_014996 | Homo sapiens phospholipase C, eta 1 (PLCH1) transcript variant 2, mRNA. | PLCH1 is a member of the PLC-eta family of the phosphoinositide-specific phospholipase C (PLC) superfamily of enzymes that cleave phosphatidylinositol 4,5-bisphosphate (PtdIns(4,5)P2) to generate second messengers inositol 1,4,5-trisphosphate (IP3) and diacylglycerol (DAG) (Hwang et al., 2005 [PubMed 15702972]). [supplied by OMIM, June 2009]. Transcript Variant: This variant (2) differs in the 5' UTR and contains an alternate in-frame coding exon compared to variant 1. These differences cause translation initiation at a downstream AUG and an isoform (b) with a shorter N-terminus compared to isoform a. |
| BCKDHB | N | 1377 | NM_000056 | Homo sapiens branched chain keto acid dehydrogenase E1, beta polypeptide (BCKDHB), nuclear gene encoding | Branched-chain keto acid dehydrogenase is a multienzyme complex associated with the inner membrane of mitochondria, and functions in the catabolism of branched-chain amino acids. The complex consists of multiple copies of 3 components: branched-chain alpha-keto acid decarboxylase (E1), lipoamide acyltransferase (E2) and lipoamide dehydrogenase (E3). This gene encodes the E1 beta subunit, and mutations therein have been associated with maple syrup urine disease (MSUD), type |

TABLE 4-continued

| Gene name | Exon overlap | SEQ ID No | RefSeq Accession Number | mRNA Description | RefSeq Summary |
|---|---|---|---|---|---|
| | | | | mitochondrial protein, transcript variant 2, mRNA. | 1B, a disease characterized by a maple syrup odor to the urine in addition to mental and physical retardation, and feeding problems. Alternative splicing at this locus results in transcript variants with different 3' non-coding regions, but encoding the same isoform. [provided by RefSeq, July 2008]. Transcript Variant: This variant (2) is missing a segment in the 3' UTR compared to transcript variant 1, and thus has a shorter 3' UTR. Both variants 1 and 2 encode the same protein. |
| BCKDHB | N | 1378 | NM_183050 | Homo sapiens branched chain keto acid dehydrogenase E1, beta polypeptide (BCKDHB), nuclear gene encoding mitochondrial protein, transcript variant 1, mRNA. | Branched-chain keto acid dehydrogenase is a multienzyme complex associated with the inner membrane of mitochondria, and functions in the catabolism of branched-chain amino acids. The complex consists of multiple copies of 3 components: branched-chain alpha-keto acid decarboxylase (E1), lipoamide acyltransferase (E2) and lipoamide dehydrogenase (E3). This gene encodes the E1 beta subunit, and mutations therein have been associated with maple syrup urine disease (MSUD), type 1B, a disease characterized by a maple syrup odor to the urine in addition to mental and physical retardation, and feeding problems. Alternative splicing at this locus results in transcript variants with different 3' non-coding regions, but encoding the same isoform. [provided by RefSeq, July 2008]. Transcript Variant: This variant (1) represents the longer transcript. Both variants 1 and 2 encode the same protein. Sequence Note: This RefSeq record was created from transcript and genomic sequence data to make the sequence consistent with the reference genome assembly. The extent of this transcript is supported by transcript alignments. |
| BRD7P3 | Y | 1379 | NR_002730 | Homo sapiens bromodomain containing 7 pseudogene 3 (BRD7P3), non-coding RNA. | N/A |
| PLN | Y | 1380 | NM_002667 | Homo sapiens phospholamban (PLN), mRNA. | The protein encoded by this gene is found as a pentamer and is a major substrate for the cAMP-dependent protein kinase in cardiac muscle. The encoded protein is an inhibitor of cardiac muscle sarcoplasmic reticulum Ca(2+)-ATPase in the unphosphorylated state, but inhibition is relieved upon phosphorylation of the protein. The subsequent activation of the Ca(2+) pump leads to enhanced muscle relaxation rates, thereby contributing to the inotropic response elicited in heart by beta-agonists. The encoded protein is a key regulator of cardiac diastolic function. Mutations in this gene are a cause of inherited human dilated cardiomyopathy with refractory congestive heart failure. [provided by RefSeq, July 2008]. |
| SYNE1 | Y | 1381 | NM_033071 | Homo sapiens spectrin repeat containing, nuclear envelope 1 (SYNE1), transcript variant 2, mRNA. | This gene encodes a spectrin repeat containing protein expressed in skeletal and smooth muscle, and peripheral blood lymphocytes, that localizes to the nuclear membrane. Mutations in this gene have been associated with autosomal recessive spinocerebellar ataxia 8, also referred to as autosomal recessive cerebellar ataxia type 1 or recessive ataxia of Beauce. Alternatively spliced transcript variants encoding different isoforms have been described. [provided by RefSeq, July 2008]. Transcript Variant: This variant (2) differs in the 5' UTR and has multiple coding region differences, compared to variant 1. This results in a shorter protein (isoform 2 which has also been referred to as the shorter isoform), compared to isoform 1. |
| SYNE1 | Y | 1382 | NM_182961 | Homo sapiens spectrin repeat containing, nuclear envelope 1 (SYNE1), transcript variant 1, mRNA. | This gene encodes a spectrin repeat containing protein expressed in skeletal and smooth muscle, and peripheral blood lymphocytes, that localizes to the nuclear membrane. Mutations in this gene have been associated with autosomal recessive spinocerebellar ataxia 8, also referred to as autosomal recessive cerebellar ataxia type 1 or recessive ataxia of Beauce. Alternatively spliced transcript variants encoding different isoforms have been described. [provided by RefSeq, July 2008]. Transcript Variant: This variant (1) represents the longest transcript and encodes the longest protein (isoform 1 which has also been referred to as the longest isoform). |
| SRPK2 | N | 1383 | NM_182691 | Homo sapiens SRSF protein kinase 2 (SRPK2), transcript variant 2, mRNA. | N/A |

TABLE 4-continued

| Gene name | Exon overlap | SEQ ID No | RefSeq Accession Number | mRNA Description | RefSeq Summary |
|---|---|---|---|---|---|
| SRPK2 | N | 1384 | NM_182692 | *Homo sapiens* SRSF protein kinase 2 (SRPK2), transcript variant 1, mRNA. | N/A |
| MGAM | Y | 1385 | NM_004668 | *Homo sapiens* maltase-glucoamylase (alpha-glucosidase) (MGAM), mRNA. | This gene encodes maltase-glucoamylase, which is a brush border membrane enzyme that plays a role in the final steps of digestion of starch. The protein has two catalytic sites identical to those of sucrase-isomaltase, but the proteins are only 59% homologous. Both are members of glycosyl hydrolase family 31, which has a variety of substrate specificities. [provided by RefSeq, July 2008]. |
| PXDNL | N | 1386 | NM_144651 | *Homo sapiens* peroxidasin homolog (*Drosophila*)-like (PXDNL), mRNA. | N/A |
| C9orf85 | Y | 1387 | NM_182505 | *Homo sapiens* chromosome 9 open reading frame 85 (C9orf85), mRNA. | N/A |
| C9orf102 | N | 1388 | NM_001010895 | *Homo sapiens* chromosome 9 open reading frame 102 (C9orf102), mRNA. | N/A |
| HBG1 | Y | 1389 | NM_000559 | *Homo sapiens* hemoglobin, gamma A (HBG1), mRNA. | The gamma globin genes (HBG1 and HBG2) are normally expressed in the fetal liver, spleen and bone marrow. Two gamma chains together with two alpha chains constitute fetal hemoglobin (HbF) which is normally replaced by adult hemoglobin (HbA) at birth. In some beta-thalassemias and related conditions, gamma chain production continues into adulthood. The two types of gamma chains differ at residue 136 where glycine is found in the G-gamma product (HBG2) and alanine is found in the A-gamma product (HBG1). The former is predominant at birth. The order of the genes in the beta-globin cluster is: 5'-epsilon -- gamma-G -- gamma-A -- delta -- beta-3'. [provided by RefSeq, July 2008]. |
| PDHX | N | 1390 | NM_001135024 | *Homo sapiens* pyruvate dehydrogenase complex, component X (PDHX), transcript variant 2, mRNA. | The pyruvate dehydrogenase (PDH) complex is located in the mitochondrial matrix and catalyzes the conversion of pyruvate to acetyl coenzyme A. The PDH complex thereby links glycolysis to Krebs cycle. The PDH complex contains three catalytic subunits, E1, E2, and E3, two regulatory subunits, E1 kinase and E1 phosphatase, and a non-catalytic subunit; also known as component X of the pyruvate dehydrogenase complex. This protein tethers E3 dimers to the E2 core of the PDH complex. Defects in this gene are a cause of pyruvate dehydrogenase deficiency which results in neurological dysfunction and lactic acidosis in infancy and early childhood. This protein is also a minor antigen for antimitochondrial antibodies. These autoantibodies are present in nearly 95% of patients with the autoimmune liver disease primary biliary cirrhosis (PBC). In PBC, activated T lymphocytes attack and destroy epithelial cells in the bile duct where this protein is abnormally distributed and overexpressed. PBC eventually leads to cirrhosis and liver failure. Alternative splicing results in multiple transcript variants encoding distinct isoforms. [provided by RefSeq, October 2009]. Transcript Variant: This variant (2) lacks a segment in the 5' region, resulting in upstream in-frame AUG start codon, as compared to variant 1. The resulting isoform (2) has a shorter and distinct N-terminus, as compared to isoform 1. |
| PDHX | N | 1391 | NM_001166158 | *Homo sapiens* pyruvate dehydrogenase complex, component X (PDHX), nuclear gene encoding mitochondrial protein, transcript variant 3, mRNA. | The pyruvate dehydrogenase (PDH) complex is located in the mitochondrial matrix and catalyzes the conversion of pyruvate to acetyl coenzyme A. The PDH complex thereby links glycolysis to Krebs cycle. The PDH complex contains three catalytic subunits, E1, E2, and E3, two regulatory subunits, E1 kinase and E1 phosphatase, and a non-catalytic subunit; also known as component X of the pyruvate dehydrogenase complex. This protein tethers E3 dimers to the E2 core of the PDH complex. Defects in this gene are a cause of pyruvate dehydrogenase deficiency which results in neurological dysfunction and lactic acidosis in infancy and early childhood. This protein is also a minor antigen for antimitochondrial antibodies. These autoantibodies are present in nearly 95% of patients with the autoimmune liver disease primary biliary cirrhosis (PBC). In PBC, activated T lymphocytes attack and destroy epithelial cells in the bile duct where this protein is abnormally distributed and overexpressed. PBC eventually leads to cirrhosis |

TABLE 4-continued

| Gene name | Exon overlap | SEQ ID No | RefSeq Accession Number | mRNA Description | RefSeq Summary |
|---|---|---|---|---|---|
| PDHX | N | 1392 | NM_003477 | Homo sapiens pyruvate dehydrogenase complex, component X (PDHX), nuclear gene encoding mitochondrial protein, transcript variant 1, mRNA. | and liver failure. Alternative splicing results in multiple transcript variants encoding distinct isoforms. [provided by RefSeq, October 2009]. Transcript Variant: This variant (3) lacks multiple in-frame exons in the central coding region, compared to variant 1, resulting in a protein (isoform 3) that lacks 227 aa, compared to isoform 1. Sequence Note: The RefSeq transcript and protein were derived from transcript and genomic sequence to make the sequence consistent with the reference genome assembly. The genomic coordinates used for the transcript record were based on alignments.<br>The pyruvate dehydrogenase (PDH) complex is located in the mitochondrial matrix and catalyzes the conversion of pyruvate to acetyl coenzyme A. The PDH complex thereby links glycolysis to Krebs cycle. The PDH complex contains three catalytic subunits, E1, E2, and E3, two regulatory subunits, E1 kinase and E1 phosphatase, and a non-catalytic subunit; also known as component X of the pyruvate dehydrogenase complex. This protein tethers E3 dimers to the E2 core of the PDH complex. Defects in this gene are a cause of pyruvate dehydrogenase deficiency which results in neurological dysfunction and lactic acidosis in infancy and early childhood. This protein is also a minor antigen for antimitochondrial antibodies. These autoantibodies are present in nearly 95% of patients with the autoimmune liver disease primary biliary cirrhosis (PBC). In PBC, activated T lymphocytes attack and destroy epithelial cells in the bile duct where this protein is abnormally distributed and overexpressed. PBC eventually leads to cirrhosis and liver failure. Alternative splicing results in multiple transcript variants encoding distinct isoforms. [provided by RefSeq, October 2009]. Transcript Variant: This variant (1) encodes the longest isoform (1). Sequence Note: The RefSeq transcript and protein were derived from transcript and genomic sequence to make the sequence consistent with the reference genome assembly. The genomic coordinates used for the transcript record were based on alignments. |
| SORL1 | N | 1393 | NM_003105 | Homo sapiens sortilin-related receptor, L(DLR class) A repeats containing (SORL1), mRNA. | This gene encodes a mosaic protein that belongs to at least two families: the vacuolar protein sorting 10 (VPS10) domain-containing receptor family, and the low density lipoprotein receptor (LDLR) family. The encoded protein also contains fibronectin type III repeats and an epidermal growth factor repeat. The encoded protein is translated as a preproprotein and likely plays roles in endocytosis and sorting. There may be an association between expression of this locus and Alzheimer's Disease. [provided by RefSeq, September 2010]. Sequence Note: This RefSeq record was created from transcript and genomic sequence data to make the sequence consistent with the reference genome assembly. The genomic coordinates used for the transcript record were based on transcript alignments. |
| LIN7A | N | 1394 | NM_004664 | Homo sapiens lin-7 homolog A (C. elegans) (LIN7A), mRNA. | N/A |
| ATXN2 | N | 1395 | NM_002973 | Homo sapiens ataxin 2 (ATXN2), mRNA. | The autosomal dominant cerebellar ataxias (ADCA) are a heterogeneous group of neurodegenerative disorders characterized by progressive degeneration of the cerebellum, brain stem and spinal cord. Clinically, ADCA has been divided into three groups: ADCA types I-III. Defects in this gene are the cause of spinocerebellar ataxia type 2 (SCA2). ADCA belongs to the autosomal dominant cerebellar ataxias type I (ADCA I) which are characterized by cerebellar ataxia in combination with additional clinical features like optic atrophy, ophthalmoplegia, bulbar and extrapyramidal signs, peripheral neuropathy and dementia. SCA2 is caused by expansion of a CAG repeat in the coding region of this gene. This locus has been mapped to chromosome 12, and it has been determined that the diseased allele contains 37-50 CAG repeats, compared to 17-29 in the normal allele. Longer expansions result in earlier onset of the disease. Alternatively spliced transcript variants encoding different isoforms have been identified but their full length sequence has not been determined. [provided by RefSeq, January 2010]. |
| NALCN | N | 1396 | NM_052867 | Homo sapiens sodium leak channel, non-selective (NALCN), mRNA. | NALCN forms a voltage-independent, nonselective, noninactivating cation channel permeable to Na+, K+, and Ca(2+). It is responsible for the neuronal background sodium leak conductance (Lu et al., 2007 [PubMed 17448995]). [supplied by OMIM, March 2008]. |

TABLE 4-continued

| Gene name | Exon overlap | SEQ ID No | RefSeq Accession Number | mRNA Description | RefSeq Summary |
|---|---|---|---|---|---|
| SLC10A2 | Y | 1397 | NM_000452 | Homo sapiens solute carrier family 10 (sodium/bile acid cotransporter family), member 2 (SLC10A2), mRNA. | This gene encodes a sodium/bile acid cotransporter. This transporter is the primary mechanism for uptake of intestinal bile acids by apical cells in the distal ileum. Bile acids are the catabolic product of cholesterol metabolism, so this protein is also critical for cholesterol homeostasis. Mutations in this gene cause primary bile acid malabsorption (PBAM); muatations in this gene may also be associated with other diseases of the liver and intestines, such as familial hypertriglyceridemia (FHTG). [provided by RefSeq, March 2010]. |
| MIR208B | Y | 1398 | NR_030624 | Homo sapiens microRNA 208b (MIR208B), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents a predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MYH6 | Y | 1399 | NM_002471 | Homo sapiens myosin, heavy chain 6, cardiac muscle, alpha (MYH6), mRNA. | Cardiac muscle myosin is a hexamer consisting of two heavy chain subunits, two light chain subunits, and two regulatory subunits. This gene encodes the alpha heavy chain subunit of cardiac myosin. The gene is located 4kb downstream of the gene encoding the beta heavy chain subunit of cardiac myosin. Mutations in this gene cause familial hypertrophic cardiomyopathy and atrial septal defect 3. [provided by RefSeq, March 2010]. |
| MYH7 | Y | 1400 | NM_000257 | Homo sapiens myosin, heavy chain 7, cardiac muscle, beta (MYH7), mRNA. | Muscle myosin is a hexameric protein containing 2 heavy chain subunits, 2 alkali light chain subunits, and 2 regulatory light chain subunits. This gene encodes the beta (or slow) heavy chain subunit of cardiac myosin. It is expressed predominantly in normal human ventricle. It is also expressed in skeletal muscle tissues rich in slow-twitch type I muscle fibers. Changes in the relative abundance of this protein and the alpha (or fast) heavy subunit of cardiac myosin correlate with the contractile velocity of cardiac muscle. Its expression is also altered during thyroid hormone depletion and hemodynamic overloading. Mutations in this gene are associated with familial hypertrophic cardiomyopathy, myosin storage myopathy, dilated cardiomyopathy, and Laing early-onset distal myopathy. [provided by RefSeq, July 2008]. |
| MDGA2 | N | 1401 | NM_001113498 | Homo sapiens MAM domain containing glycosylphosphatidylinositol anchor 2 (MDGA2), transcript variant 1, mRNA. | N/A |
| MDGA2 | N | 1402 | NM_182830 | Homo sapiens MAM domain containing glycosylphosphatidylinositol anchor 2 (MDGA2), transcript variant 2, mRNA. | N/A |
| UNC13C | N | 1403 | NM_001080534 | Homo sapiens unc-13 homolog C (C. elegans) (UNC13C), mRNA. | N/A |
| LOC283922 | Y | 1404 | NR_026950 | Homo sapiens pyruvate dehydrogenase phosphatase regulatory subunit | N/A |

TABLE 4-continued

| Gene name | Exon overlap | SEQ ID No | RefSeq Accession Number | mRNA Description | RefSeq Summary |
|---|---|---|---|---|---|
| INTS2 | N | 1405 | NM_020748 | pseudogene (LOC283922), non-coding RNA. *Homo sapiens* integrator complex subunit 2 (INTS2), transcript variant 1, mRNA. | INTS2 is a subunit of the Integrator complex, which associates with the C-terminal domain of RNA polymerase II large subunit (POLR2A; MIM 180660) and mediates 3-prime end processing of small nuclear RNAs U1 (RNU1; MIM 180680) and U2 (RNU2; MIM 180690) (Baillat et al., 2005 [PubMed 16239144]). [supplied by OMIM, March 2008]. Transcript Variant: This variant (1) is the protein-coding variant. Sequence Note: This RefSeq record was created from transcript and genomic sequence data because no single transcript was available for the full length of the gene. The extent of this transcript is supported by transcript alignments. |
| INTS2 | N | 1406 | NR_026641 | *Homo sapiens* integrator complex subunit 2 (INTS2), transcript variant 2, non-coding RNA. | INTS2 is a subunit of the Integrator complex, which associates with the C-terminal domain of RNA polymerase II large subunit (POLR2A; MIM 180660) and mediates 3-prime end processing of small nuclear RNAs U1 (RNU1; MIM 180680) and U2 (RNU2; MIM 180690) (Baillat et al., 2005 [PubMed 16239144]). [supplied by OMIM, March 2008]. Transcript Variant: This variant (2) uses an alternate splice junction downstream of the translation start site used in variant 1, resulting in a severely truncated protein product. Therefore, it is likely that variant 2 does not encode a protein. Sequence Note: This RefSeq record was created from transcript and genomic sequence data because no single transcript was available for the full length of the gene. The extent of this transcript is supported by transcript alignments. |
| CYP2A6 | Y | 1407 | NM_000762 | *Homo sapiens* cytochrome P450, family 2, subfamily A, polypeptide 6 (CYP2A6), mRNA. | This gene, CYP2A6, encodes a member of the cytochrome P450 superfamily of enzymes. The cytochrome P450 proteins are monooxygenases which catalyze many reactions involved in drug metabolism and synthesis of cholesterol, steroids and other lipids. This protein localizes to the endoplasmic reticulum and its expression is induced by phenobarbital. The enzyme is known to hydroxylate coumarin, and also metabolizes nicotine, aflatoxin B1, nitrosamines, and some pharmaceuticals. Individuals with certain allelic variants are said to have a poor metabolizer phenotype, meaning they do not efficiently metabolize coumarin or nicotine. This gene is part of a large cluster of cytochrome P450 genes from the CYP2A, CYP2B and CYP2F subfamilies on chromosome 19q. The gene was formerly referred to as CYP2A3; however, it has been renamed CYP2A6. [provided by RefSeq, July 2008]. |
| SIRPB1 | N | 1408 | NM_001083910 | *Homo sapiens* signal-regulatory protein beta 1 (SIRPB1), transcript variant 2, mRNA. | The protein encoded by this gene is a member of the signal-regulatory-protein (SIRP) family, and also belongs to the immunoglobulin superfamily. SIRP family members are receptor-type transmembrane glycoproteins known to be involved in the negative regulation of receptor tyrosine kinase-coupled signaling processes. This protein was found to interact with TYROBP/DAP12, a protein bearing immunoreceptor tyrosine-based activation motifs. This protein was also reported to participate in the recruitment of tyrosine kinase SYK. Multiple transcript variants encoding different isoforms have been found for this gene. [provided by RefSeq, February 2009]. Transcript Variant: This variant (2) lacks two in-frame coding exons in the 3' region compared to variant 1. The resulting isoform (2) lacks an internal segment compared to isoform 1. |
| SIRPB1 | N | 1409 | NM_001135844 | *Homo sapiens* signal-regulatory protein beta 1 (SIRPB1), transcript variant 3, mRNA. | The protein encoded by this gene is a member of the signal-regulatory-protein (SIRP) family, and also belongs to the immunoglobulin superfamily. SIRP family members are receptor-type transmembrane glycoproteins known to be involved in the negative regulation of receptor tyrosine kinase-coupled signaling processes. This protein was found to interact with TYROBP/DAP12, a protein bearing immunoreceptor tyrosine-based activation motifs. This protein was also reported to participate in the recruitment of tyrosine kinase SYK. Multiple transcript variants encoding different isoforms have been found for this gene. [provided by RefSeq, February 2009]. Transcript Variant: This variant (3) differs in the 3' UTR and coding sequence compared to variant 1. The resulting isoform (3) is similar in sequence to isoform 1 and contains the same number of aa as does isoform 1. |
| SIRPB1 | N | 1410 | NM_006065 | *Homo sapiens* signal-regulatory protein beta 1 (SIRPB1), transcript variant | The protein encoded by this gene is a member of the signal-regulatory-protein (SIRP) family, and also belongs to the immunoglobulin superfamily. SIRP family members are receptor-type transmembrane glycoproteins known to be involved in the negative regulation of receptor tyrosine kinase-coupled |

TABLE 4-continued

| Gene name | Exon overlap | SEQ ID No | RefSeq Accession Number | mRNA Description | RefSeq Summary |
|---|---|---|---|---|---|
| | | | | | signaling processes. This protein was found to interact with TYROBP/DAP12, a protein bearing immunoreceptor tyrosine-based activation motifs. This protein was also reported to participate in the recruitment of tyrosine kinase SYK. Multiple transcript variants encoding different isoforms have been found for this gene. [provided by RefSeq, February 2009]. Transcript Variant: This variant (1) encodes the longest transcript and the longer isoform (1). Variants 1 and 3 encode different proteins having the same number of aa. |
| CENPVL1 | Y | 1411 | NR_033772 | Homo sapiens centromere protein V-like 1 (CENPVL1), non-coding RNA. | N/A |
| CXorf27 | Y | 1412 | NM_012274 | Homo sapiens chromosome X open reading frame 27 (CXorf27), mRNA. | This gene encodes a protein shown to interact with huntingtin, which contains an expanded polyglutamine tract in individuals with Huntington's disease (PMID: 9700202). [provided by RefSeq, August 2011]. |
| CXorf40B | Y | 1413 | NM_001013845 | Homo sapiens chromosome X open reading frame 40B (CXorf40B), mRNA. | N/A |
| EDA2R | Y | 1414 | NM_001199687 | Homo sapiens ectodysplasin A2 receptor (EDA2R), transcript variant 1, mRNA. | EDA-A1 and EDA-A2 are two isoforms of ectodysplasin that are encoded by the anhidrotic ectodermal dysplasia (EDA) gene. Mutations in EDA give rise to a clinical syndrome characterized by loss of hair, sweat glands, and teeth. The protein encoded by this gene specifically binds to EDA-A2 isoform. This protein is a type III transmembrane protein of the TNFR (tumor necrosis factor receptor) superfamily, and contains 3 cysteine-rich repeats and a single transmembrane domain but lacks an N-terminal signal peptide. Alternatively spliced transcript variants have been found for this gene. [provided by RefSeq, May 2011]. Transcript Variant: This variant (1) represents the longer transcript. Variants 1 and 2 both encode the same protein (isoform 1). |
| EDA2R | Y | 1415 | NM_001242310 | Homo sapiens ectodysplasin A2 receptor (EDA2R), transcript variant 3, mRNA. | EDA-A1 and EDA-A2 are two isoforms of ectodysplasin that are encoded by the anhidrotic ectodermal dysplasia (EDA) gene. Mutations in EDA give rise to a clinical syndrome characterized by loss of hair, sweat glands, and teeth. The protein encoded by this gene specifically binds to EDA-A2 isoform. This protein is a type III transmembrane protein of the TNFR (tumor necrosis factor receptor) superfamily, and contains 3 cysteine-rich repeats and a single transmembrane domain but lacks an N-terminal signal peptide. Alternatively spliced transcript variants have been found for this gene. [provided by RefSeq, May 2011]. Transcript Variant: This variant (3) contains an alternate exon and uses an alternate splice site in the 3 coding region but maintains the reading frame compared to variant 1. The resulting protein (isoform 2) is longer compared to isoform 1. Sequence Note: This RefSeq record was created from transcript and genomic sequence data to make the sequence consistent with the reference genome assembly. The genomic coordinates used for the transcript record were based on transcript alignments. |
| EDA2R | Y | 1416 | NM_021783 | Homo sapiens ectodysplasin A2 receptor (EDA2R), transcript variant 2, mRNA. | EDA-A1 and EDA-A2 are two isoforms of ectodysplasin that are encoded by the anhidrotic ectodermal dysplasia (EDA) gene. Mutations in EDA give rise to a clinical syndrome characterized by loss of hair, sweat glands, and teeth. The protein encoded by this gene specifically binds to EDA-A2 isoform. This protein is a type III transmembrane protein of the TNFR (tumor necrosis factor receptor) superfamily, and contains 3 cysteine-rich repeats and a single transmembrane domain but lacks an N-terminal signal peptide. Alternatively spliced transcript variants have been found for this gene. [provided by RefSeq, May 2011]. Transcript Variant: This variant (2) differs in the 5' UTR compared to variant 1. Variants 1 and 2 both encode the same protein (isoform 1). Publication Note: This RefSeq record includes a subset of the publications that are available for this gene. Please see the Gene record to access additional publications. |

TABLE 4-continued

| Gene name | Exon overlap | SEQ ID No | RefSeq Accession Number | mRNA Description | RefSeq Summary |
|---|---|---|---|---|---|
| F8 | Y | 1417 | NM_000132 | *Homo sapiens* coagulation factor VIII, procoagulant component (F8), transcript variant 1, mRNA. | This gene encodes coagulation factor VIII, which participates in the intrinsic pathway of blood coagulation; factor VIII is a cofactor for factor IXa which, in the presence of Ca+2 and phospholipids, converts factor X to the activated form Xa. This gene produces two alternatively spliced transcripts. Transcript variant 1 encodes a large glycoprotein, isoform a, which circulates in plasma and associates with von Willebrand factor in a noncovalent complex. This protein undergoes multiple cleavage events. Transcript variant 2 encodes a putative small protein, isoform b, which consists primarily of the phospholipid binding domain of factor VIIIc. This binding domain is essential for coagulant activity. Defects in this gene results in hemophilia A, a common recessive X-linked coagulation disorder. [provided by RefSeq, July 2008]. Transcript Variant: This variant (1) consists of 26 exons and encodes the full-length isoform (a). |
| F8 | Y | 1418 | NM_019863 | *Homo sapiens* coagulation factor VIII, procoagulant component (F8), transcript variant 2, mRNA. | This gene encodes coagulation factor VIII, which participates in the intrinsic pathway of blood coagulation; factor VIII is a cofactor for factor IXa which, in the presence of Ca+2 and phospholipids, converts factor X to the activated form Xa. This gene produces two alternatively spliced transcripts. Transcript variant 1 encodes a large glycoprotein, isoform a, which circulates in plasma and associates with von Willebrand factor in a noncovalent complex. This protein undergoes multiple cleavage events. Transcript variant 2 encodes a putative small protein, isoform b, which consists primarily of the phospholipid binding domain of factor VIIIc. This binding domain is essential for coagulant activity. Defects in this gene results in hemophilia A, a common recessive X-linked coagulation disorder. [provided by RefSeq, July 2008]. Transcript Variant: This variant (2) contains an unique 5' exon located within intron 22 of transcript variant 1. This exon codes for eight amino acids and is spliced to exons 23-26 maintaining the reading frame. The resulting isoform (b) is considerably shorter compared to isoform a, and includes the phospholipid binding domain. |
| FLNA | Y | 1419 | NM_001110556 | *Homo sapiens* filamin A, alpha (FLNA), transcript variant 2, mRNA. | The protein encoded by this gene is an actin-binding protein that crosslinks actin filaments and links actin filaments to membrane glycoproteins. The encoded protein is involved in remodeling the cytoskeleton to effect changes in cell shape and migration. This protein interacts with integrins, transmembrane receptor complexes, and second messengers. Defects in this gene are a cause of several syndromes, including periventricular nodular heterotopias (PVNH1, PVNH4), otopalatodigital syndromes (OPD1, OPD2), frontometaphyseal dysplasia (FMD), Melnick-Needles syndrome (MNS), and X-linked congenital idiopathic intestinal pseudoobstruction (CIIPX). Two transcript variants encoding different isoforms have been found for this gene. [provided by RefSeq, March 2009]. Transcript Variant: This variant (2) includes an alternate in-frame exon and encodes a slightly longer protein isoform (2). |
| FLNA | Y | 1420 | NM_001080489 | *Homo sapiens* filamin A, alpha (FLNA), transcript variant 1, mRNA. | The protein encoded by this gene is an actin-binding protein that crosslinks actin filaments and links actin filaments to membrane glycoproteins. The encoded protein is involved in remodeling the cytoskeleton to effect changes in cell shape and migration. This protein interacts with integrins, transmembrane receptor complexes, and second messengers. Defects in this gene are a cause of several syndromes, including periventricular nodular heterotopias (PVNH1, PVNH4), otopalatodigital syndromes (OPD1, OPD2), frontometaphyseal dysplasia (FMD), Melnick-Needles syndrome (MNS), and X-linked congenital idiopathic intestinal pseudoobstruction (CIIPX). Two transcript variants encoding different isoforms have been found for this gene. [provided by RefSeq, March 2009]. Transcript Variant: This variant (1) is the predominant transcript and encodes a slightly shorter protein isoform (1). |
| GLOD5 | Y | 1421 | NM_001080489 | *Homo sapiens* glyoxalase domain containing 5 (GLOD5), mRNA. | This gene encodes a protein with a glyoxalase domain. [provided by RefSeq, September 2011]. |
| L1CAM | Y | 1422 | NM_000425 | *Homo sapiens* L1 cell adhesion molecule (L1CAM), transcript variant 1, mRNA. | The protein encoded by this gene is an axonal glycoprotein belonging to the immunoglobulin supergene family. The ectodomain, consisting of several immunoglobulin-like domains and fibronectin-like repeats (type III), is linked via a single transmembrane sequence to a conserved cytoplasmic domain. This cell adhesion molecule plays an important role in nervous system development, including neuronal migration and differentiation. Mutations in the gene cause three X- |

TABLE 4-continued

| Gene name | Exon overlap | SEQ ID No | RefSeq Accession Number | mRNA Description | RefSeq Summary |
|---|---|---|---|---|---|
| L1CAM | Y | 1423 | NM_001143963 | Homo sapiens L1 cell adhesion molecule (L1CAM), transcript variant 3, mRNA. | linked neurological syndromes known by the acronym CRASH (corpus callosum hypoplasia, retardation, aphasia, spastic paraplegia and hydrocephalus). Alternative splicing of a neuron-specific exon is thought to be functionally relevant. [provided by RefSeq, July 2008]. Transcript Variant: This variant (1) includes a neuron-specific exon in the 3' region and encodes the full-length isoform (1). The protein encoded by this gene is an axonal glycoprotein belonging to the immunoglobulin supergene family. The ectodomain, consisting of several immunoglobulin-like domains and fibronectin-like repeats (type III), is linked via a single transmembrane sequence to a conserved cytoplasmic domain. This cell adhesion molecule plays an important role in nervous system development, including neuronal migration and differentiation. Mutations in the gene cause three X-linked neurological syndromes known by the acronym CRASH (corpus callosum hypoplasia, retardation, aphasia, spastic paraplegia and hydrocephalus). Alternative splicing of a neuron-specific exon is thought to be functionally relevant. [provided by RefSeq, July 2008]. Transcript Variant: This variant (3) lacks an internal exon in the 5' region and a neuron-specific exon in the 3' region, as compared to variant 1. The resulting isoform (3) is shorter, and lacks an internal segment in the N-terminus and is missing a tyrosine-based sorting motif in the C-terminus. |
| L1CAM | Y | 1424 | NM_024003 | Homo sapiens L1 cell adhesion molecule (L1CAM), transcript variant 2, mRNA. | The protein encoded by this gene is an axonal glycoprotein belonging to the immunoglobulin supergene family. The ectodomain, consisting of several immunoglobulin-like domains and fibronectin-like repeats (type III), is linked via a single transmembrane sequence to a conserved cytoplasmic domain. This cell adhesion molecule plays an important role in nervous system development, including neuronal migration and differentiation. Mutations in the gene cause three X-linked neurological syndromes known by the acronym CRASH (corpus callosum hypoplasia, retardation, aphasia, spastic paraplegia and hydrocephalus). Alternative splicing of a neuron-specific exon is thought to be functionally relevant. [provided by RefSeq, July 2008]. Transcript Variant: This variant (2) lacks a neuron-specific exon in the 3' region, as compared to variant 1. The resulting isoform (2) is shorter and is missing a tyrosine-based sorting motif. |
| LOC100272228 | Y | 1425 | NR_027456 | Homo sapiens uncharacterized LOC100272228 (LOC100272228), non-coding RNA. | N/A |
| LOC286467 | Y | 1426 | NR_026975 | Homo sapiens family with sequence similarity 195, member A pseudogene (LOC286467), non-coding RNA. | N/A |
| LOC401588 | Y | 1427 | NR_015378 | Homo sapiens uncharacterized LOC401588 (LOC401588), non-coding RNA. | N/A |
| LOC441495 | Y | 1428 | NR_033773 | Homo sapiens centromere protein V pseudogene (LOC441495), non-coding RNA. | N/A |
| LOC92249 | Y | 1429 | NR_015353 | Homo sapiens uncharacterized LOC92249 (LOC92249), non-coding RNA. | N/A |
| MAGEA11 | Y | 1430 | NM_0010011544 | Homo sapiens melanoma antigen family A, 11 | This gene is a member of the MAGEA gene family. The members of this family encode proteins with 50 to 80% sequence identity to each other. The promoters and first exons of the MAGEA genes show |

TABLE 4-continued

| Gene name | Exon overlap | SEQ ID No | RefSeq Accession Number | mRNA Description | RefSeq Summary |
|---|---|---|---|---|---|
| | | | | (MAGEA11), transcript variant 2, mRNA. | considerable variability, suggesting that the existence of this gene family enables the same function to be expressed under different transcriptional controls. The MAGEA genes are clustered at chromosomal location Xq28. They have been implicated in some hereditary disorders, such as dyskeratosis congenita. Two transcript variants encoding different isoforms have been found for this gene. [provided by RefSeq, July 2008]. Transcript Variant: This variant (2) differs in the 5' UTR and CDS compared to variant 1. The resulting isoform (b) is shorter and has a distinct N-terminus compared to isoform a. Publication Note: This RefSeq record includes a subset of the publications that are available for this gene. Please see the Gene record to access additional publications. |
| MAGEA11 | Y | 1431 | NM_005366 | Homo sapiens melanoma antigen family A, 11 (MAGEA11), transcript variant 1, mRNA. | This gene is a member of the MAGEA gene family. The members of this family encode proteins with 50 to 80% sequence identity to each other. The promoters and first exons of the MAGEA genes show considerable variability, suggesting that the existence of this gene family enables the same function to be expressed under different transcriptional controls. The MAGEA genes are clustered at chromosomal location Xq28. They have been implicated in some hereditary disorders, such as dyskeratosis congenita. Two transcript variants encoding different isoforms have been found for this gene. [provided by RefSeq, July 2008]. Transcript Variant: This variant (1) encodes the longer isoform (a). Publication Note: This RefSeq record includes a subset of the publications that are available for this gene. Please see the Gene record to access additional publications. |
| MAGEC1 | Y | 1432 | NM_005462 | Homo sapiens melanoma antigen family C, 1 (MAGEC1), mRNA. | This gene is a member of the melanoma antigen gene (MAGE) family. The proteins of this family are tumor-specific antigens that can be recognized by autologous cytolytic T lymphocytes. This protein contains a large number of unique short repetitive sequences in front of the MAGE-homologous sequence, and therefore is about 800 aa longer than the other MAGE proteins. [provided by RefSeq, July 2008]. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| MAGEC3 | Y | 1433 | NM_138702 | Homo sapiens melanoma antigen family C, 3 (MAGEC3), transcript variant 1, mRNA. | This gene is a member of the MAGEC gene family. The members of this family are not expressed in normal tissues, except for testis, and are expressed in tumors of various histological types. The MAGEC genes are clustered on chromosome Xq26-q27. Two transcript variants encoding distinct isoforms have been found for this gene. [provided by RefSeq, July 2008]. Transcript Variant: This variant (1) is the longer transcript and encodes the longer isoform (1). |
| MAGEC3 | Y | 1434 | NM_177456 | Homo sapiens melanoma antigen family C, 3 (MAGEC3), transcript variant 2, mRNA. | This gene is a member of the MAGEC gene family. The members of this family are not expressed in normal tissues, except for testis, and are expressed in tumors of various histological types. The MAGEC genes are clustered on chromosome Xq26-q27. Two transcript variants encoding distinct isoforms have been found for this gene. [provided by RefSeq, July 2008]. Transcript Variant: This variant (2) has several alternate splice sites, as compared to variant 1. It encodes the shorter isoform (2), which has different N- and C-termini, as compared to isoform 1. |
| MAGT1 | Y | 1435 | NM_032121 | Homo sapiens magnesium transporter 1 (MAGT1), mRNA. | This gene encodes a magnesium cation transporter protein that localizes to the cell membrane. This protein also associates with N-oligosaccharyl transferase and therefore may have a role in N-glycosylation. Mutations in this gene cause mental retardation X-linked type 95 (MRX95). This gene may have multiple in-frame translation initiation sites, one of which would encode a shorter protein with an N-terminus containing a signal peptide at amino acids 1-29. [provided by RefSeq, January 2010]. |
| MCART6 | Y | 1436 | NM_001012755 | Homo sapiens mitochondrial carrier triple repeat 6 (MCART6), nuclear gene encoding mitochondrial protein, mRNA. | N/A |
| MIR890 | Y | 1437 | NM_030589 | Homo sapiens microRNA 890 (MIR890), microRNA. | microRNAs (miRNAs) are short (20-24 nt) non-coding RNAs that are involved in post-transcriptional regulation of gene expression in multicellular organisms by affecting both the stability and translation |

TABLE 4-continued

| Gene name | Exon overlap | SEQ ID No | RefSeq Accession Number | mRNA Description | RefSeq Summary |
|---|---|---|---|---|---|
| | | | | | of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| NSDHL | Y | 1438 | NM_001129765 | Homo sapiens NAD(P) dependent steroid dehydrogenase-like (NSDHL), transcript variant 2, mRNA. | The protein encoded by this gene is localized in the endoplasmic reticulum and is involved in cholesterol biosynthesis. Mutations in this gene are associated with CHILD syndrome, which is a X-linked dominant disorder of lipid metabolism with disturbed cholesterol biosynthesis, and typically lethal in males. Alternatively spliced transcript variants with differing 5' UTR have been found for this gene. [provided by RefSeq, July 2008]. Transcript Variant: This variant (2) contains an additional 5' non-coding exon, hence has a longer 5' UTR compared to variant 1. Transcript variants 1 and 2 encode the same protein. Publication Note: This RefSeq record includes a subset of the publications that are available for this gene. Please see the Gene record to access additional publications. |
| NSDHL | Y | 1439 | NM_015922 | Homo sapiens NAD(P) dependent steroid dehydrogenase-like (NSDHL), transcript variant 1, mRNA. | The protein encoded by this gene is localized in the endoplasmic reticulum and is involved in cholesterol biosynthesis. Mutations in this gene are associated with CHILD syndrome, which is a X-linked dominant disorder of lipid metabolism with disturbed cholesterol biosynthesis, and typically lethal in males. Alternatively spliced transcript variants with differing 5' UTR have been found for this gene. [provided by RefSeq, July 2008]. Transcript Variant: This variant (1) represents the more predominant transcript. Transcript variants 1 and 2 encode the same protein. |
| NUDT10 | Y | 1440 | NM_153183 | Homo sapiens nudix (nucleoside diphosphate linked moiety X)-type motif 10 (NUDT10), mRNA. | NUDT10 belongs to a subgroup of phosphohydrolases that preferentially attack diphosphoinositol polyphosphates (Hidaka et al., 2002 [PubMed 12105228]). [supplied by OMIM, March 2008]. Sequence Note: removed 2 bases from the 5' end that did not align to the reference genome assembly. |
| NUDT11 | Y | 1441 | NM_018159 | Homo sapiens nudix (nucleoside diphosphate linked moiety X)-type motif 11 (NUDT11), mRNA. | NUDT11 belongs to a subgroup of phosphohydrolases that preferentially attack diphosphoinositol polyphosphates (Hidaka et al., 2002 [PubMed 12105228]). [supplied by OMIM, March 2008]. |
| OR13H1 | Y | 1442 | NM_001004486 | Homo sapiens olfactory receptor, family 13, subfamily H, member 1 (OR13H1), mRNA. | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, July 2008]. |
| PRRG1 | Y | 1443 | NM_000950 | Homo sapiens proline rich Gla (G-carboxyglutamic acid) 1 (PRRG1), transcript variant 1, mRNA. | This gene encodes a vitamin K-dependent, gamma-carboxyglutamic acid (Gla)-containing, single-pass transmembrane protein. This protein contains a Gla domain at the N-terminus, preceded by a propeptide sequence required for post-translational gamma-carboxylation of specific glutamic acid residues by a vitamin K-dependent gamma-carboxylase. The C-terminus is proline-rich containing PPXY and PXXP motifs found in a variety of signaling and cytoskeletal proteins. This gene is highly expressed in the spinal cord. Several alternatively spliced transcript variants have been found for this gene. [provided by RefSeq, March 2010]. Transcript Variant: This variant (1) represents the longest transcript and encodes the longer isoform (1). Variants 1-4 encode the same isoform. |

TABLE 4-continued

| Gene name | Exon overlap | SEQ ID No | RefSeq Accession Number | mRNA Description | RefSeq Summary |
|---|---|---|---|---|---|
| PRRG1 | Y | 1444 | NM_001142395 | Homo sapiens proline rich Gla (G-carboxyglutamic acid) 1 (PRRG1), transcript variant 2, mRNA. | This gene encodes a vitamin K-dependent, gamma-carboxyglutamic acid (Gla)-containing, single-pass transmembrane protein. This protein contains a Gla domain at the N-terminus, preceded by a propeptide sequence required for post-translational gamma-carboxylation of specific glutamic acid residues by a vitamin K-dependent gamma-carboxylase. The C-terminus is proline-rich containing PPXY and PXXP motifs found in a variety of signaling and cytoskeletal proteins. This gene is highly expressed in the spinal cord. Several alternatively spliced transcript variants have been found for this gene. [provided by RefSeq, March 2010]. Transcript Variant: This variant (2) is missing a 5' non-coding exon compared to variant 1. Variants 1-4 encode the same isoform (1). |
| PRRG1 | Y | 1445 | NM_001173486 | Homo sapiens proline rich Gla (G-carboxyglutamic acid) 1 (PRRG1), transcript variant 5, mRNA. | This gene encodes a vitamin K-dependent, gamma-carboxyglutamic acid (Gla)-containing, single-pass transmembrane protein. This protein contains a Gla domain at the N-terminus, preceded by a propeptide sequence required for post-translational gamma-carboxylation of specific glutamic acid residues by a vitamin K-dependent gamma-carboxylase. The C-terminus is proline-rich containing PPXY and PXXP motifs found in a variety of signaling and cytoskeletal proteins. This gene is highly expressed in the spinal cord. Several alternatively spliced transcript variants have been found for this gene. [provided by RefSeq, March 2010]. Transcript Variant: This variant (5) is missing a 5' non-coding exon, and contains an alternate 3' terminal exon compared to variant 1. The latter causes a frame-shift and a shorter isoform (2) with a distinct C-terminus compared to isoform 1. Isoform 2 retains a partial Gla domain at the N-terminus, however, this protein is predicted and lacks experimental evidence. |
| PRRG1 | Y | 1446 | NM_001173489 | Homo sapiens proline rich Gla (G-carboxyglutamic acid) 1 (PRRG1), transcript variant 3, mRNA. | This gene encodes a vitamin K-dependent, gamma-carboxyglutamic acid (Gla)-containing, single-pass transmembrane protein. This protein contains a Gla domain at the N-terminus, preceded by a propeptide sequence required for post-translational gamma-carboxylation of specific glutamic acid residues by a vitamin K-dependent gamma-carboxylase. The C-terminus is proline-rich containing PPXY and PXXP motifs found in a variety of signaling and cytoskeletal proteins. This gene is highly expressed in the spinal cord. Several alternatively spliced transcript variants have been found for this gene. [provided by RefSeq, March 2010]. Transcript Variant: This variant (3) uses an alternative donor splice site at the 5' terminal non-coding exon compared to variant 1. Variants 1-4 encode the same isoform (1). |
| PRRG1 | Y | 1447 | NM_001173490 | Homo sapiens proline rich Gla (G-carboxyglutamic acid) 1 (PRRG1), transcript variant 4, mRNA. | This gene encodes a vitamin K-dependent, gamma-carboxyglutamic acid (Gla)-containing, single-pass transmembrane protein. This protein contains a Gla domain at the N-terminus, preceded by a propeptide sequence required for post-translational gamma-carboxylation of specific glutamic acid residues by a vitamin K-dependent gamma-carboxylase. The C-terminus is proline-rich containing PPXY and PXXP motifs found in a variety of signaling and cytoskeletal proteins. This gene is highly expressed in the spinal cord. Several alternatively spliced transcript variants have been found for this gene. [provided by RefSeq, March 2010]. Transcript Variant: This variant (4) uses an alternative donor splice site at the 5' terminal non-coding exon, and is missing another 5' non-coding exon compared to variant 1. Variants 1-4 encode the same isoform (1). |
| SPIN4 | Y | 1448 | NM_001012968 | Homo sapiens spindlin family, member 4 (SPIN4), mRNA. | N/A |
| SYTL5 | Y | 1449 | NM_001163334 | Homo sapiens synaptotagmin-like 5 (SYTL5), transcript variant 3, mRNA. | The protein encoded by this gene belongs to the synaptotagmin-like (Slp) protein family, which contains a unique homology domain at the N-terminus, referred to as the Slp homology domain (SHD). The SHD functions as a binding site for Rab27A, which plays a role in protein transport. Expression of this gene is restricted to placenta and liver, suggesting that it might be involved in Rab27A-dependent membrane trafficking in specific tissues. Alternatively spliced transcript variants encoding different isoforms have been found for this gene. [provided by RefSeq, September 2009]. Transcript Variant: This variant (3) contains an in-frame coding exon missing in variant 1, resulting in a longer isoform (2) with an additional 22 aa protein segment compared to isoform 1. |
| SYTL5 | Y | 1450 | NM_001163335 | Homo sapiens synaptotagmin-like 5 | The protein encoded by this gene belongs to the synaptotagmin-like (Slp) protein family, which contains a unique homology domain at the N-terminus, referred to as the Slp homology domain (SHD). |

TABLE 4-continued

| Gene name | Exon overlap | SEQ ID No | RefSeq Accession Number | mRNA Description | RefSeq Summary |
|---|---|---|---|---|---|
| SYTL5 | Y | 1451 | NM_138780 | (SYTL5), transcript variant 2, mRNA. | The SHD functions as a binding site for Rab27A, which plays a role in protein transport. Expression of this gene is restricted to placenta and liver, suggesting that it might be involved in Rab27A-dependent membrane trafficking in specific tissues. Alternatively spliced transcript variants encoding different isoforms have been found for this gene. [provided by RefSeq, September 2009]. Transcript Variant: This variant (2) differs in the 5' UTR compared to variant 1. Variants 1 and 2 encode the same isoform (1). |
| SYTL5 | Y | 1451 | NM_138780 | Homo sapiens synaptotagmin-like 5 (SYTL5), transcript variant 1, mRNA. | The protein encoded by this gene belongs to the synaptotagmin-like (Slp) protein family, which contains a unique homology domain at the N-terminus, referred to as the Slp homology domain (SHD). The SHD functions as a binding site for Rab27A, which plays a role in protein transport. Expression of this gene is restricted to placenta and liver, suggesting that it might be involved in Rab27A-dependent membrane trafficking in specific tissues. Alternatively spliced transcript variants encoding different isoforms have been found for this gene. [provided by RefSeq, September 2009]. Transcript Variant: This variant (1) encodes the shorter isoform (1). Variants 1 and 2 encode the same isoform. |
| TAF7L | Y | 1452 | NM_001168474 | Homo sapiens TAF7-like RNA polymerase II, TATA box binding protein (TBP)-associated factor, 50 kDa (TAF7L), transcript variant 2, mRNA. | This gene is similar to a mouse gene that encodes a TATA box binding protein-associated factor, and shows testis-specific expression. The encoded protein could be a spermatogenesis-specific component of the DNA-binding general transcription factor complex TFIID. Alternatively spliced transcript variants encoding different isoforms have been found for this gene. [provided by RefSeq, December 2009]. Transcript Variant: This variant (2) differs in the 5' UTR, lacks a portion of the 5' coding region, and initiates translation at a downstream start codon, compared to variant 1. The encoded isoform (2) has a shorter N-terminus, compared to isoform 1. |
| TAF7L | Y | 1453 | NM_024885 | Homo sapiens TAF7-like RNA polymerase II, TATA box binding protein (TBP)-associated factor, 50 kDa (TAF7L), transcript variant 1, mRNA. | This gene is similar to a mouse gene that encodes a TATA box binding protein-associated factor, and shows testis-specific expression. The encoded protein could be a spermatogenesis-specific component of the DNA-binding general transcription factor complex TFIID. Alternatively spliced transcript variants encoding different isoforms have been found for this gene. [provided by RefSeq, December 2009]. Transcript Variant: This variant (1) represents the longer transcript and encodes the longer isoform (1). |
| TMEM185A | both | 1454 | NM_001174092 | Homo sapiens transmembrane protein 185A (TMEM185A), transcript variant 2, mRNA. | The protein encoded by this gene is predicted to be a transmembrane protein, but this has not been experimentally determined. This gene is better known for localizing to the CpG island of the fragile site FRAXF. The 5-prime untranslated region of this gene contains a CGG trinucleotide repeat sequence that normally consists of 7-40 tandem CGG repeats but which can expand to greater than 300 repeats. Methylation of the CpG island leads to transcriptional silencing of this gene, but neither the silencing nor an expanded repeat region appear to manifest itself in a clear phenotypic manner. Two transcript variants encoding different isoforms have been found for this gene. [provided by RefSeq, March 2010]. Transcript Variant: This variant (2) lacks an alternate in-frame exon compared to variant 1. The resulting isoform (2) has the same N- and C-termini but is shorter compared to isoform 1. Sequence Note: This RefSeq record was created from transcript and genomic sequence data to make the sequence consistent with the reference genome assembly. The genomic coordinates used for the transcript record were based on transcript alignments. |
| TMEM185A | both | 1455 | NM_032508 | Homo sapiens transmembrane protein 185A (TMEM185A), transcript variant 1, mRNA. | The protein encoded by this gene is predicted to be a transmembrane protein, but this has not been experimentally determined. This gene is better known for localizing to the CpG island of the fragile site FRAXF. The 5-prime untranslated region of this gene contains a CGG trinucleotide repeat sequence that normally consists of 7-40 tandem CGG repeats but which can expand to greater than 300 repeats. Methylation of the CpG island leads to transcriptional silencing of this gene, but neither the silencing nor an expanded repeat region appear to manifest itself in a clear phenotypic manner. Two transcript variants encoding different isoforms have been found for this gene. [provided by RefSeq, March 2010]. Transcript Variant: This variant (1) represents the longer transcript and encodes the longer isoform (1). Sequence Note: This RefSeq record was created from transcript and genomic sequence data to make the sequence consistent with the reference genome assembly. The genomic coordinates used for the transcript record were based on transcript alignments. |

TABLE 4-continued

| Gene name | SEQ ID No | RefSeq Accession Number | mRNA Description | Exon overlap | RefSeq Summary |
|---|---|---|---|---|---|
| TMLHE | 1456 | NM_001184797 | *Homo sapiens* trimethyllysine hydroxylase, epsilon (TMLHE), nuclear gene encoding mitochondrial protein, transcript variant 2, mRNA. | both | This gene encodes the protein trimethyllysine dioxygenase which is the first enzyme in the carnitine biosynthesis pathway. Carnitine play an essential role in the transport of activated fatty acids across the inner mitochondrial membrane. The encoded protein converts trimethyllysine into hydroxytrimethyllysine. A pseudogene of this gene is found on chromosome X. Alternate splicing results in multiple transcript variants. [provided by RefSeq, May 2010]. Transcript Variant: This variant (2) differs in the 3' UTR and coding region differences, compared to variant 1. The resulting protein (isoform 2) has a distinct C-terminus and is shorter than isoform 1. |
| TMLHE | 1457 | NM_018196 | *Homo sapiens* trimethyllysine hydroxylase, epsilon (TMLHE), nuclear gene encoding mitochondrial protein, transcript variant 1, mRNA. | both | This gene encodes the protein trimethyllysine dioxygenase which is the first enzyme in the carnitine biosynthesis pathway. Carnitine play an essential role in the transport of activated fatty acids across the inner mitochondrial membrane. The encoded protein converts trimethyllysine into hydroxytrimethyllysine. A pseudogene of this gene is found on chromosome X. Alternate splicing results in multiple transcript variants. [provided by RefSeq, May 2010]. Transcript Variant: This variant (1) represents the longer transcript and encodes the longer isoform (1). Sequence Note: This RefSeq record was created from transcript and genomic sequence data to make the sequence consistent with the reference genome assembly. The genomic coordinates used for the transcript record were based on transcript alignments. |
| ZDHHC9 | 1458 | NM_001008222 | *Homo sapiens* zinc finger, DHHC-type containing 9 (ZDHHC9), transcript variant 2, mRNA. | N | This gene encodes an integral membrane protein that is a member of the zinc finger DHHC domain-containing protein family. The encoded protein forms a complex with golgin subfamily A member 7 and functions as a palmitoyltransferase. This protein specifically palmitoylates HRAS and NRAS. Mutations in this gene are associated with X-linked mental retardation. Alternate splicing results in multiple transcript variants that encode the same protein. [provided by RefSeq, May 2010]. Transcript Variant: This variant (2) has an alternate 5' UTR and encodes the same protein, as compared to variant 1. Sequence Note: This RefSeq record was created from transcript and genomic sequence data to make the sequence consistent with the reference genome assembly. The genomic coordinates used for the transcript record were based on transcript alignments. |
| ZDHHC9 | 1459 | NM_016032 | *Homo sapiens* zinc finger, DHHC-type containing 9 (ZDHHC9), transcript variant 1, mRNA. | N | This gene encodes an integral membrane protein that is a member of the zinc finger DHHC domain-containing protein family. The encoded protein forms a complex with golgin subfamily A member 7 and functions as a palmitoyltransferase. This protein specifically palmitoylates HRAS and NRAS. Mutations in this gene are associated with X-linked mental retardation. Alternate splicing results in multiple transcript variants that encode the same protein. [provided by RefSeq, May 2010]. Transcript Variant: This variant (1) is the longer transcript and both variants 1 and 2 encode the same protein. Sequence Note: This RefSeq record was created from transcript and genomic sequence data to make the sequence consistent with the reference genome assembly. The genomic coordinates used for the transcript record were based on transcript alignments. |
| ZNF674 | 1460 | NM_001039891 | *Homo sapiens* zinc finger protein 674 (ZNF674), transcript variant 1, mRNA. | Y | This gene encodes a zinc finger protein with an N-terminal Kruppel-associated box-containing (KRAB) domain and 11 Kruppel-type C2H2 zinc finger domains. Like other zinc finger proteins, this gene may function as a transcription factor. This gene resides on an area of chromosome X that has been implicated in nonsyndromic X-linked mental retardation. Alternative splicing results in multiple transcript variants encoding different isoforms. [provided by RefSeq, June 2010]. Transcript Variant: This variant (1) encodes the longer isoform (1). Sequence Note: This RefSeq record was created from transcript and genomic sequence data to make the sequence consistent with the reference genome assembly. The genomic coordinates used for the transcript record were based on transcript alignments. |
| ZNF674 | 1461 | NM_001146291 | *Homo sapiens* zinc finger protein 674 (ZNF674), transcript variant 2, mRNA. | Y | This gene encodes a zinc finger protein with an N-terminal Kruppel-associated box-containing (KRAB) domain and 11 Kruppel-type C2H2 zinc finger domains. Like other zinc finger proteins, this gene resides on an area of chromosome X that has been implicated in nonsyndromic X-linked mental retardation. Alternative splicing results in multiple transcript variants encoding different isoforms. [provided by RefSeq, June 2010]. Transcript Variant: This variant (2) uses alternate in-frame donor and acceptor splice sites at two coding exons compared to variant 1, resulting in an isoform (2), which is 6 aa shorter than isoform 1. Sequence Note: This |

TABLE 4-continued

| Gene name | Exon overlap | SEQ ID No | RefSeq Accession Number | mRNA Description | RefSeq Summary |
|---|---|---|---|---|---|
| | | | | | RefSeq record was created from transcript and genomic sequence data to make the sequence consistent with the reference genome assembly. The genomic coordinates used for the transcript record were based on transcript alignments. |
| ZNF674 | Y | 1462 | NM_001190417 | *Homo sapiens* zinc finger protein 674 (ZNF674), transcript variant 3, mRNA. | This gene encodes a zinc finger protein with an N-terminal Kruppel-associated box-containing (KRAB) domain and 11 Kruppel-type C2H2 zinc finger domains. Like other zinc finger proteins, this gene may function as a transcription factor. This gene resides on an area of chromosome X that has been implicated in nonsyndromic X-linked mental retardation. Alternative splicing results in multiple transcript variants encoding different isoforms. [provided by RefSeq, June 2010]. Transcript Variant: This variant (3) uses an alternate in-frame splice site at a coding exon, compared to variant 1, resulting in an isoform (3), which is 5 aa shorter than isoform 1. Sequence Note: This RefSeq record was created from transcript and genomic sequence data to make the sequence consistent with the reference genome assembly. The genomic coordinates used for the transcript record were based on transcript alignments. |
| OXR1 | N | 1463 | NM_001198532 | *Homo sapiens* oxidation resistance 1 (OXR1), transcript variant 3, mRNA. | N/A |
| OXR1 | N | 1464 | NM_001198533 | *Homo sapiens* oxidation resistance 1 (OXR1), transcript variant 4, mRNA. | N/A |
| OXR1 | N | 1465 | NM_001198534 | *Homo sapiens* oxidation resistance 1 (OXR1), transcript variant 5, mRNA. | N/A |
| OXR1 | N | 1466 | NM_001198535 | *Homo sapiens* oxidation resistance 1 (OXR1), transcript variant 6, mRNA. | N/A |
| OXR1 | N | 1467 | NM_018002 | *Homo sapiens* oxidation resistance 1 (OXR1), transcript variant 1, mRNA. | N/A |
| OXR1 | N | 1468 | NM_181354 | *Homo sapiens* oxidation resistance 1 (OXR1), transcript variant 2, mRNA. | N/A |
| PTGER3 | Y | 1469 | NM_001126044 | *Homo sapiens* prostaglandin E receptor 3 (subtype EP3) (PTGER3), transcript variant 11, mRNA. | The protein encoded by this gene is a member of the G-protein coupled receptor family. This protein is one of four receptors identified for prostaglandin E2 (PGE2). This receptor may have many biological functions, which involve digestion, nervous system, kidney reabsorption, and uterine contraction activities. Studies of the mouse counterpart suggest that this receptor may also mediate adrenocorticotropic hormone response as well as fever generation in response to exogenous and endogenous stimuli. Multiple transcript variants encoding different isoforms have been found for this gene. [provided by RefSeq, August 2009]. Transcript Variant: This variant (11) has multiple differences compared to variant 1. The resulting protein (isoform 4) has a distinct and shorter C-terminus, as compared to isoform 1. Transcript variants 4, 9 and 11 encode the same protein. Another name for this transcript is EP3 subtype 1c. Sequence Note: This RefSeq record was created from transcript and genomic sequence data because no single transcript was available for the full length of the gene. The extent of this transcript is supported by transcript alignments. |
| PTGER3 | Y | 1470 | NM_198714 | *Homo sapiens* prostaglandin E receptor 3 (subtype EP3) (PTGER3), transcript variant 4, mRNA. | The protein encoded by this gene is a member of the G-protein coupled receptor family. This protein is one of four receptors identified for prostaglandin E2 (PGE2). This receptor may have many biological functions, which involve digestion, nervous system, kidney reabsorption, and uterine contraction activities. Studies of the mouse counterpart suggest that this receptor may also mediate adrenocorticotropic hormone response as well as fever generation in response to exogenous and endogenous stimuli. Multiple transcript variants encoding different isoforms have been found for this gene. [provided by RefSeq, August 2009]. Transcript Variant: This variant (4) has multiple differences |

TABLE 4-continued

| Gene name | Exon overlap | SEQ ID No | RefSeq Accession Number | mRNA Description | RefSeq Summary |
|---|---|---|---|---|---|
| PTGER3 | | | | | compared to variant 1. The resulting protein (isoform 4) has a distinct and shorter C-terminus, as compared to isoform 1. Transcript variants 4, 9 and 11 encode the same protein. Other names for variant 4 are EP3 subtype 1b, pEPR-1b, and EP3a1. |
| PTGER3 | Y | 1471 | NM_198715 | Homo sapiens prostaglandin E receptor 3 (subtype EP3) (PTGER3), transcript variant 5, mRNA. | The protein encoded by this gene is a member of the G-protein coupled receptor family. This protein is one of four receptors identified for prostaglandin E2 (PGE2). This receptor may have many biological functions, which involve digestion, nervous system, kidney reabsorption, and uterine contraction activities. Studies of the mouse counterpart suggest that this receptor may also mediate adrenocorticotropic hormone response as well as fever generation in response to exogenous and endogenous stimuli. Multiple transcript variants encoding different isoforms have been found for this gene. [provided by RefSeq, August 2009]. Transcript Variant: This variant (5) lacks multiple 3' exons and has an unique 3' end region when compared to variant 1. The resulting protein (isoform 5) has a distinct and shorter C-terminus, as compared to isoform 1. Other names for this transcript are EP3-II, EP3C, and EP3D. |
| PTGER3 | Y | 1472 | NM_198716 | Homo sapiens prostaglandin E receptor 3 (subtype EP3) (PTGER3), transcript variant 6, mRNA. | The protein encoded by this gene is a member of the G-protein coupled receptor family. This protein is one of four receptors identified for prostaglandin E2 (PGE2). This receptor may have many biological functions, which involve digestion, nervous system, kidney reabsorption, and uterine contraction activities. Studies of the mouse counterpart suggest that this receptor may also mediate adrenocorticotropic hormone response as well as fever generation in response to exogenous and endogenous stimuli. Multiple transcript variants encoding different isoforms have been found for this gene. [provided by RefSeq, August 2009]. Transcript Variant: This variant (6) lacks two coding exons compared to variant 1. The resulting protein (isoform 6) has a distinct and shorter C-terminus, as compared to isoform 1. Other names for this transcript are EP3F and EP3d. Publication Note: This RefSeq record includes a subset of the publications that are available for this gene. Please see the Gene record to access additional publications. |
| PTGER3 | Y | 1473 | NM_198717 | Homo sapiens prostaglandin E receptor 3 (subtype EP3) (PTGER3), transcript variant 7, mRNA. | The protein encoded by this gene is a member of the G-protein coupled receptor family. This protein is one of four receptors identified for prostaglandin E2 (PGE2). This receptor may have many biological functions, which involve digestion, nervous system, kidney reabsorption, and uterine contraction activities. Studies of the mouse counterpart suggest that this receptor may also mediate adrenocorticotropic hormone response as well as fever generation in response to exogenous and endogenous stimuli. Multiple transcript variants encoding different isoforms have been found for this gene. [provided by RefSeq, August 2009]. Transcript Variant: This variant (7) lacks multiple exons compared to variant 1. The resulting protein (isoform 7) has a distinct and shorter C-terminus as compared to isoform 1. Other names for this transcript are EP3b and EP3E. Publication Note: This RefSeq record includes a subset of the publications that are available for this gene. Please see the Gene record to access additional publications. |
| PTGER3 | Y | 1474 | NM_198718 | Homo sapiens prostaglandin E receptor 3 (subtype EP3) (PTGER3), transcript variant 8, mRNA. | The protein encoded by this gene is a member of the G-protein coupled receptor family. This protein is one of four receptors identified for prostaglandin E2 (PGE2). This receptor may have many biological functions, which involve digestion, nervous system, kidney reabsorption, and uterine contraction activities. Studies of the mouse counterpart suggest that this receptor may also mediate adrenocorticotropic hormone response as well as fever generation in response to exogenous and endogenous stimuli. Multiple transcript variants encoding different isoforms have been found for this gene. [provided by RefSeq, August 2009]. Transcript Variant: This variant (8) has multiple differences compared to variant 1. The resulting protein (isoform 8) has a distinct and shorter C-terminus, as compared to isoform 1. Another name for this transcript is EP3e. Publication Note: This RefSeq record includes a subset of the publications that are available for this gene. Please see the Gene record to access additional publications. |
| PTGER3 | Y | 1475 | NM_198719 | Homo sapiens prostaglandin E receptor 3 (subtype EP3) | The protein encoded by this gene is a member of the G-protein coupled receptor family. This protein is one of four receptors identified for prostaglandin E2 (PGE2). This receptor may have many |

TABLE 4-continued

| Gene name | Exon overlap | SEQ ID No | RefSeq Accession Number | mRNA Description | RefSeq Summary |
|---|---|---|---|---|---|
| | | | | (PTGER3), transcript variant 9, mRNA. | biological functions, which involve digestion, nervous system, kidney reabsorption, and uterine contraction activities. Studies of the mouse counterpart suggest that this receptor may also mediate adrenocorticotropic hormone response as well as fever generation in response to exogenous and endogenous stimuli. Multiple transcript variants encoding different isoforms have been found for this gene. [provided by RefSeq, August 2009]. Transcript Variant: This variant (9) has multiple differences compared to variant 1. The resulting protein (isoform 4) has a distinct and shorter C-terminus, as compared to isoform 1. Transcript variants 4, 9 and 11 encode the same protein. Other names for variant 9 are EP3A, EP3-I, EP3a2, and EP3 subtype 1a. |
| PTGER3 | Y | 1476 | NR_028292 | Homo sapiens prostaglandin E receptor 3 (subtype EP3) (PTGER3), transcript variant 2, non-coding RNA. | The protein encoded by this gene is a member of the G-protein coupled receptor family. This protein is one of four receptors identified for prostaglandin E2 (PGE2). This receptor may have many biological functions, which involve digestion, nervous system, kidney reabsorption, and uterine contraction activities. Studies of the mouse counterpart suggest that this receptor may also mediate adrenocorticotropic hormone response as well as fever generation in response to exogenous and endogenous stimuli. Multiple transcript variants encoding different isoforms have been found for this gene. [provided by RefSeq, August 2009]. Transcript Variant: This variant (2), also known as EP3-V, lacks one exon and includes an additional exon near the 3' end, compared to variant 1. This variant is represented as non-coding because the use of the 5'-most supported translational start codon, as used in variant 7, renders the transcript a candidate for nonsense-mediated mRNA decay (NMD). Sequence Note: This RefSeq record was created from transcript and genomic sequence data to make the sequence consistent with the reference genome assembly. The genomic coordinates used for the transcript record were based on transcript alignments. |
| PTGER3 | Y | 1477 | NR_028293 | Homo sapiens prostaglandin E receptor 3 (subtype EP3) (PTGER3), transcript variant 3, non-coding RNA. | The protein encoded by this gene is a member of the G-protein coupled receptor family. This protein is one of four receptors identified for prostaglandin E2 (PGE2). This receptor may have many biological functions, which involve digestion, nervous system, kidney reabsorption, and uterine contraction activities. Studies of the mouse counterpart suggest that this receptor may also mediate adrenocorticotropic hormone response as well as fever generation in response to exogenous and endogenous stimuli. Multiple transcript variants encoding different isoforms have been found for this gene. [provided by RefSeq, August 2009]. Transcript Variant: This variant (3), also known as EP3-VI, lacks two and includes one alternate exon, compared to variant 1. This variant is represented as non-coding because the use of the 5'-most supported translational start codon, as used in variant 7, renders the transcript a candidate for nonsense-mediated mRNA decay (NMD). Sequence Note: This RefSeq record was created from transcript and genomic sequence data to make the sequence consistent with the reference genome assembly. The genomic coordinates used for the transcript record were based on transcript alignments. |
| PTGER3 | Y | 1478 | NR_028294 | Homo sapiens prostaglandin E receptor 3 (subtype EP3) (PTGER3), transcript variant 1, non-coding RNA. | The protein encoded by this gene is a member of the G-protein coupled receptor family. This protein is one of four receptors identified for prostaglandin E2 (PGE2). This receptor may have many biological functions, which involve digestion, nervous system, kidney reabsorption, and uterine contraction activities. Studies of the mouse counterpart suggest that this receptor may also mediate adrenocorticotropic hormone response as well as fever generation in response to exogenous and endogenous stimuli. Multiple transcript variants encoding different isoforms have been found for this gene. [provided by RefSeq, August 2009]. Transcript Variant: This variant (1), also known as EP3f, represents the longest transcript. This variant is represented as non-coding because the use of the 5'-most supported translational start codon, as used in variant 7, renders the transcript a candidate for nonsense-mediated mRNA decay (NMD). Sequence Note: This RefSeq record was created from transcript and genomic sequence data to make the sequence consistent with the reference genome assembly. The genomic coordinates used for the transcript record were based on transcript alignments. |

TABLE 4-continued

| Gene name | Exon overlap | SEQ ID No | RefSeq Accession Number | mRNA Description | RefSeq Summary |
|---|---|---|---|---|---|
| C6orf162 | Y | 1479 | NM_001042493 | Homo sapiens chromosome 6 open reading frame 162 (C6orf162), transcript variant 1, mRNA. | N/A |
| C6orf162 | Y | 1480 | NM_020425 | Homo sapiens chromosome 6 open reading frame 162 (C6orf162), transcript variant 2, mRNA. | N/A |
| GJB7 | Y | 1481 | NM_198568 | Homo sapiens gap junction protein, beta 7, 25 kDa (GJB7), mRNA. | Connexins, such as GJB7, are involved in the formation of gap junctions, intercellular conduits that directly connect the cytoplasms of contacting cells. Each gap junction channel is formed by docking of 2 hemichannels, each of which contains 6 connexin subunits (Sohl et al., 2003 [PubMed 12881038]). [supplied by OMIM, March 2008]. |
| VPS13A | Y | 1482 | NM_001018037 | Homo sapiens vacuolar protein sorting 13 homolog A (S. cerevisiae) (VPS13A), transcript variant C, mRNA. | The protein encoded by this gene may control steps in the cycling of proteins through the trans-Golgi network to endosomes, lysosomes and the plasma membrane. Mutations in this gene cause the autosomal recessive disorder, chorea-acanthocytosis. Alternative splicing of this gene results in multiple transcript variants. [provided by RefSeq, July 2008]. Transcript Variant: This variant (C), also known as 2A, lacks an alternate in-frame segment, compared to variant A, resulting in a shorter protein (isoform C), compared to isoform A. |
| VPS13A | Y | 1483 | NM_001018038 | Homo sapiens vacuolar protein sorting 13 homolog A (S. cerevisiae) (VPS13A), transcript variant D, mRNA. | The protein encoded by this gene may control steps in the cycling of proteins through the trans-Golgi network to endosomes, lysosomes and the plasma membrane. Mutations in this gene cause the autosomal recessive disorder, chorea-acanthocytosis. Alternative splicing of this gene results in multiple transcript variants. [provided by RefSeq, July 2008]. Transcript Variant: This variant (D), also known as 1D, contains a distinct 3' coding region and 3' UTR, compared to variant A. The resulting isoform (D) has a shorter C-terminus compared to isoform A. |
| VPS13A | Y | 1484 | NM_015186 | Homo sapiens vacuolar protein sorting 13 homolog A (S. cerevisiae) (VPS13A), transcript variant B, mRNA. | The protein encoded by this gene may control steps in the cycling of proteins through the trans-Golgi network to endosomes, lysosomes and the plasma membrane. Mutations in this gene cause the autosomal recessive disorder, chorea-acanthocytosis. Alternative splicing of this gene results in multiple transcript variants. [provided by RefSeq, July 2008]. Transcript Variant: This variant (B) contains a distinct 3' coding region and 3' UTR, compared to variant A. The resulting isoform (B) has a shorter C-terminus compared to isoform A. |
| VPS13A | Y | 1485 | NM_033305 | Homo sapiens vacuolar protein sorting 13 homolog A (S. cerevisiae) (VPS13A), transcript variant A, mRNA. | The protein encoded by this gene may control steps in the cycling of proteins through the trans-Golgi network to endosomes, lysosomes and the plasma membrane. Mutations in this gene cause the autosomal recessive disorder, chorea-acanthocytosis. Alternative splicing of this gene results in multiple transcript variants. [provided by RefSeq, July 2008]. Transcript Variant: This variant (A) encodes the longest isoform (A). |
| JAG2 | Y | 1486 | NM_002226 | Homo sapiens jagged 2 (JAG2), transcript variant 1, mRNA. | The Notch signaling pathway is an intercellular signaling mechanism that is essential for proper embryonic development. Members of the Notch gene family encode transmembrane receptors that are critical for various cell fate decisions. The protein encoded by this gene is one of several ligands that activate Notch and related receptors. Two transcript variants encoding different isoforms have been found for this gene. [provided by RefSeq, July 2008]. Transcript Variant: This variant (1) represents the longer transcript and encodes the longer isoform (a). |
| JAG2 | Y | 1487 | NM_145159 | Homo sapiens jagged 2 (JAG2), transcript variant 2, mRNA. | The Notch signaling pathway is an intercellular signaling mechanism that is essential for proper embryonic development. Members of the Notch gene family encode transmembrane receptors that are critical for various cell fate decisions. The protein encoded by this gene is one of several ligands that activate Notch and related receptors. Two transcript variants encoding different isoforms have been found for this gene. [provided by RefSeq, July 2008]. Transcript Variant: This variant (2) lacks an alternate in-frame exon compared to variant 1, resulting in a shorter protein (isoform b) than isoform a encoded by variant 1. Isoform b is also known as hJAG2.del-E6. |

TABLE 4-continued

| Gene name | Exon overlap | SEQ ID No | RefSeq Accession Number | mRNA Description | RefSeq Summary |
|---|---|---|---|---|---|
| PACS2 | Y | 1488 | NM_001100913 | *Homo sapiens* phosphofurin acidic cluster sorting protein 2 (PACS2), transcript variant 1, mRNA. | N/A |
| PACS2 | Y | 1489 | NM_001243127 | *Homo sapiens* phosphofurin acidic cluster sorting protein 2 (PACS2), transcript variant 3, mRNA. | N/A |
| PACS2 | Y | 1490 | NM_015197 | *Homo sapiens* phosphofurin acidic cluster sorting protein 2 (PACS2), transcript variant 2, mRNA. | N/A |
| NME4 | Y | 1491 | NM_005009 | *Homo sapiens* non-metastatic cells 4, protein expressed in (NME4), nuclear gene encoding mitochondrial protein, mRNA. | The nucleoside diphosphate (NDP) kinases (EC 2.7.4.6) are ubiquitous enzymes that catalyze transfer of gamma-phosphates, via a phosphohistidine intermediate, between nucleoside and dioxynucleoside tri- and diphosphates. The enzymes are products of the nm23 gene family, which includes NME4 (Milon et al., 1997 [PubMed 9099850]). [supplied by OMIM, May 2008]. |
| ZNF737 | Y | 1492 | NM_001159293 | *Homo sapiens* zinc finger protein 737 (ZNF737), mRNA. | N/A |
| ZNF486 | Y | 1493 | NM_052852 | *Homo sapiens* zinc finger protein 486 (ZNF486), mRNA. | N/A |
| SAE1 | Y | 1494 | NM_001145713 | *Homo sapiens* SUMO1 activating enzyme subunit 1 (SAE1), transcript variant 2, mRNA. | Posttranslational modification of proteins by the addition of the small protein SUMO (see SUMO1; MIM 601912), or sumoylation, regulates protein structure and intracellular localization. SAE1 and UBA2 (MIM 613295) form a heterodimer that functions as a SUMO-activating enzyme for the sumoylation of proteins (Okuma et al., 1999 [PubMed 9920803]). [supplied by OMIM, March 2010]. Transcript Variant: This variant (2) lacks two alternate exons, compared to variant 1, which causes a frameshift. The resulting protein (isoform b) has a distinct C-terminus and is shorter than isoform a. |
| SAE1 | Y | 1495 | NM_001145714 | *Homo sapiens* SUMO1 activating enzyme subunit 1 (SAE1), transcript variant 3, mRNA. | Posttranslational modification of proteins by the addition of the small protein SUMO (see SUMO1; MIM 601912), or sumoylation, regulates protein structure and intracellular localization. SAE1 and UBA2 (MIM 613295) form a heterodimer that functions as a SUMO-activating enzyme for the sumoylation of proteins (Okuma et al., 1999 [PubMed 9920803]). [supplied by OMIM, March 2010]. Transcript Variant: This variant (3) lacks an alternate exon, compared to variant 1, which causes a frameshift. The resulting protein (isoform b) has a distinct C-terminus and is shorter than isoform a. Publication Note: This RefSeq record includes a subset of the publications that are available for this gene. Please see the Gene record to access additional publications. |
| SAE1 | Y | 1496 | NM_005500 | *Homo sapiens* SUMO1 activating enzyme subunit 1 (SAE1), transcript variant 1, mRNA. | Posttranslational modification of proteins by the addition of the small protein SUMO (see SUMO1; MIM 601912), or sumoylation, regulates protein structure and intracellular localization. SAE1 and UBA2 (MIM 613295) form a heterodimer that functions as a SUMO-activating enzyme for the sumoylation of proteins (Okuma et al., 1999 [PubMed 9920803]). [supplied by OMIM, March 2010]. Transcript Variant: This variant (1) encodes the longest isoform (a). |
| SAE1 | Y | 1497 | NR_027280 | *Homo sapiens* SUMO1 activating enzyme subunit 1 (SAE1), transcript variant 4, non-coding RNA. | Posttranslational modification of proteins by the addition of the small protein SUMO (see SUMO1; MIM 601912), or sumoylation, regulates protein structure and intracellular localization. SAE1 and UBA2 (MIM 613295) form a heterodimer that functions as a SUMO-activating enzyme for the sumoylation of proteins (Okuma et al., 1999 [PubMed 9920803]). [supplied by OMIM, March 2010]. Transcript Variant: This variant (4) contains an alternate 5' exon, compared to variant 1. This variant is represented as non-coding because the use of the 5'-most supported translational start codon, as used in |

TABLE 4-continued

| Gene name | Exon overlap | SEQ ID No | RefSeq Accession Number | mRNA Description | RefSeq Summary |
|---|---|---|---|---|---|
| FAM195B | Y | 1498 | NM_001093767 | Homo sapiens family with sequence similarity 195, member B (FAM195B), transcript variant 2, mRNA. | variant 1, renders the transcript a candidate for nonsense-mediated mRNA decay (NMD). Publication Note: This RefSeq record includes a subset of the publications that are available for this gene. Please see the Gene record to access additional publications. |
| FAM195B | Y | 1499 | NM_207368 | Homo sapiens family with sequence similarity 195, member B (FAM195B), transcript variant 1, mRNA. | N/A |
| GCGR | Y | 1500 | NM_000160 | Homo sapiens glucagon receptor (GCGR), mRNA. | The protein encoded by this gene is a glucagon receptor that is important in controlling blood glucose levels. Defects in this gene are a cause of non-insulin-dependent diabetes mellitus (NIDDM). [provided by RefSeq, January 2010]. |
| LOC92659 | Y | 1501 | NR_015454 | Homo sapiens uncharacterized LOC92659 (LOC92659), non-coding RNA. | NA |
| PYCR1 | Y | 1502 | NM_006907 | Homo sapiens pyrroline-5-carboxylate reductase 1 (PYCR1), transcript variant 1, mRNA. | This gene encodes an enzyme that catalyzes the NAD(P)H-dependent conversion of pyrroline-5-carboxylate to proline. This enzyme may also play a physiologic role in the generation of NAD(P)+ in some cell types. The protein forms a homopolymer and localizes to the mitochondrion. Alternate splicing results in two transcript variants encoding different isoforms. [provided by RefSeq, July 2008]. Transcript Variant: This variant (1) encodes the longer isoform (1) of this protein. |
| PYCR1 | Y | 1503 | NM_153824 | Homo sapiens pyrroline-5-carboxylate reductase 1 (PYCR1), transcript variant 2, mRNA. | This gene encodes an enzyme that catalyzes the NAD(P)H-dependent conversion of pyrroline-5-carboxylate to proline. This enzyme may also play a physiologic role in the generation of NAD(P)+ in some cell types. The protein forms a homopolymer and localizes to the mitochondrion. Alternate splicing results in two transcript variants encoding different isoforms. [provided by RefSeq, July 2008]. Transcript Variant: This variant (2) lacks a portion of the coding region resulting in a frameshift, compared to variant 1. Isoform 2 has a distinct C-terminus compared to isoform 1. |
| RD3 | Y | 1504 | NM_001164688 | Homo sapiens retinal degeneration 3 (RD3), transcript variant 2, mRNA. | This gene encodes a retinal protein that is associated with promyelocytic leukemia-gene product (PML) bodies in the nucleus. Mutations in this gene cause Leber congenital amaurosis type 12, a disease that results in retinal degeneration. Alternative splicing results in multiple transcript variants. [provided by RefSeq, September 2009]. Transcript Variant: This variant (2) uses an alternate splice site in the 5' UTR compared to variant 1. Both variants 1 and 2 encode the same protein. |
| RD3 | Y | 1505 | NM_183059 | Homo sapiens retinal degeneration 3 (RD3), transcript variant 1, mRNA. | This gene encodes a retinal protein that is associated with promyelocytic leukemia-gene product (PML) bodies in the nucleus. Mutations in this gene cause Leber congenital amaurosis type 12, a disease that results in retinal degeneration. Alternative splicing results in multiple transcript variants. [provided by RefSeq, September 2009]. Transcript Variant: This variant (1) represents the longer transcript. Both variants 1 and 2 encode the same protein. |
| CKAP2L | Y | 1506 | NM_152515 | Homo sapiens cytoskeleton associated protein 2-like (CKAP2L), mRNA. | N/A |
| BARD1 | Y | 1507 | NM_000465 | Homo sapiens BRCA1 associated RING domain 1 (BARD1), mRNA. | This gene encodes a protein which interacts with the N-terminal region of BRCA1. In addition to its ability to bind BRCA1 in vivo and in vitro, it shares homology with the 2 most conserved regions of BRCA1: the N-terminal RING motif and the C-terminal BRCT domain. The RING motif is a cysteine-rich sequence found in a variety of proteins that regulate cell growth, including the products of tumor suppressor genes and dominant protooncogenes. This protein also contains 3 tandem ankyrin repeats. The BARD1/BRCA1 interaction is disrupted by tumorigenic amino acid substitutions in BRCA1, implying that the formation of a stable complex between these proteins may be an essential aspect of |

TABLE 4-continued

| Gene name | Exon overlap | SEQ ID No | RefSeq Accession Number | mRNA Description | RefSeq Summary |
|---|---|---|---|---|---|
| CHL1 | Y | 1508 | NM_006614 | Homo sapiens cell adhesion molecule with homology to L1CAM (close homolog of L1) (CHL1), mRNA. | BRCA1 tumor suppression. This protein may be the target of oncogenic mutations in breast or ovarian cancer. [provided by RefSeq, July 2008]. The protein encoded by this gene is a member of the L1 gene family of neural cell adhesion molecules. It is a neural recognition molecule that may be involved in signal transduction pathways. The deletion of one copy of this gene may be responsible for mental defects in patients with 3p-syndrome. Several alternatively spliced transcript variants of this gene have been described, but their full length nature is not known. [provided by RefSeq, July 2008]. |
| CABS1 | Y | 1509 | NM_033122 | Homo sapiens calcium-binding protein, spermatid-specific 1 (CABS1), mRNA. | N/A |
| PROL1 | Y | 1510 | NM_021225 | Homo sapiens proline rich, lacrimal 1 (PROL1), mRNA. | This gene encodes a member of the proline-rich protein family. The protein may provide a protective function at the eye surface. [provided by RefSeq, July 2008]. |
| SMR3A | Y | 1511 | NM_012390 | Homo sapiens submaxillary gland androgen regulated protein 3A (SMR3A), mRNA. | N/A |
| SMR3B | Y | 1512 | NM_006685 | Homo sapiens submaxillary gland androgen regulated protein 3B (SMR3B), mRNA. | N/A |
| GYPA | Y | 1513 | NM_002099 | Homo sapiens glycophorin A (MNS blood group) (GYPA), mRNA. | Glycophorins A (GYPA) and B (GYPB) are major sialoglycoproteins of the human erythrocyte membrane which bear the antigenic determinants for the MN and Ss blood groups. In addition to the M or N and S or s antigens that commonly occur in all populations, about 40 related variant phenotypes have been identified. These variants include all the variants of the Miltenberger complex and several isoforms of Sta, as well as Dantu, Sat, He, Mg, and deletion variants Ena, S-s-U- and Mk. Most of the variants are the result of gene recombinations between GYPA and GYPB. [provided by RefSeq, July 2008]. Sequence Note: This RefSeq record was created from transcript and genomic sequence data to make the sequence consistent with the reference genome assembly. The genomic coordinates used for the transcript record were based on transcript alignments. Sequence Note: This RefSeq record represents the GYPA*010101 allele. |
| TRIML2 | Y | 1514 | NM_173553 | Homo sapiens tripartite motif family-like 2 (TRIML2), mRNA. | N/A |
| LOC401164 | Y | 1515 | NR_033869 | Homo sapiens uncharacterized LOC401164 (LOC401164), non-coding RNA. | N/A |
| SIL1 | Y | 1516 | NM_001037633 | Homo sapiens SIL1 homolog, endoplasmic reticulum chaperone (S. cerevisiae) (SIL1), transcript variant 1, mRNA. | This gene encodes a resident endoplasmic reticulum (ER), N-linked glycoprotein with an N-terminal ER targeting sequence, 2 putative N-glycosylation sites, and a C-terminal ER retention signal. This protein functions as a nucleotide exchange factor for another unfolded protein response protein. Mutations in this gene have been associated with Marinesco-Sjogren syndrome. Alternate transcriptional splice variants have been characterized. [provided by RefSeq, July 2008]. Transcript Variant: This variant (1) represents the longer transcript. Variants 1 and 2 encode the same protein. Publication Note: This RefSeq record includes a subset of the publications that are available for this gene. Please see the Gene record to access additional publications. |
| SIL1 | Y | 1517 | NM_022464 | Homo sapiens SIL1 homolog, endoplasmic reticulum chaperone (S. | This gene encodes a resident endoplasmic reticulum (ER), N-linked glycoprotein with an N-terminal ER targeting sequence, 2 putative N-glycosylation sites, and a C-terminal ER retention signal. This protein functions as a nucleotide exchange factor for another unfolded protein response protein. |

TABLE 4-continued

| Gene name | Exon overlap | SEQ ID No | RefSeq Accession Number | mRNA Description | RefSeq Summary |
|---|---|---|---|---|---|
| | | | | cerevisiae) (SIL1), transcript variant 2, mRNA. | Mutations in this gene have been associated with Marinesco-Sjogren syndrome. Alternate transcriptional splice variants have been characterized. [provided by RefSeq, July 2008]. Transcript Variant: This variant (2) lacks an exon in the 5'UTR compared to variant 1. Variants 1 and 2 encode the same protein. |
| IRGM | Y | 1518 | NM_001145805 | Homo sapiens immunity-related GTPase family, M (IRGM), mRNA. | This gene encodes a member of the p47 immunity-related GTPase family. The encoded protein may play a role in the innate immune response by regulating autophagy formation in response to intracellular pathogens. Polymorphisms that affect the normal expression of this gene are associated with a susceptibility to Crohn's disease and tuberculosis. [provided by RefSeq, October 2010]. Sequence Note: The RefSeq transcript and protein were derived from genomic sequence to make the sequence consistent with the reference genome assembly. The genomic coordinates used for the transcript record were based on alignments. |
| CNR1 | Y | 1519 | NM_001160226 | Homo sapiens cannabinoid receptor 1 (brain) (CNR1), transcript variant 3, mRNA. | This gene encodes one of two cannabinoid receptors. The cannabinoids, principally delta-9-tetrahydrocannabinol and synthetic analogs, are psychoactive ingredients of marijuana. The cannabinoid receptors are members of the guanine-nucleotide-binding protein (G-protein) coupled receptor family, which inhibit adenylate cyclase activity in a dose-dependent, stereoselective and pertussis toxin-sensitive manner. The two receptors have been found to be involved in the cannabinoid-induced CNS effects (including alterations in mood and cognition) experienced by users of marijuana. Multiple transcript variants encoding two different protein isoforms have been described for this gene. [provided by RefSeq, May 2009]. Transcript Variant: This variant (3) contains an alternate exon in the 5' UTR, compared to variant 1. Variants 1, 3, 4 and 5 all encode isoform a. This variant was designated CB1B by PubMed ID: 15289816. Sequence Note: The RefSeq transcript and protein were derived from genomic sequence to make the sequence consistent with the reference genome assembly. The genomic coordinates used for the transcript record were based on alignments and by its description in PubMed ID: 15289816. |
| CNR1 | Y | 1520 | NM_001160258 | Homo sapiens cannabinoid receptor 1 (brain) (CNR1), transcript variant 4, mRNA. | This gene encodes one of two cannabinoid receptors. The cannabinoids, principally delta-9-tetrahydrocannabinol and synthetic analogs, are psychoactive ingredients of marijuana. The cannabinoid receptors are members of the guanine-nucleotide-binding protein (G-protein) coupled receptor family, which inhibit adenylate cyclase activity in a dose-dependent, stereoselective and pertussis toxin-sensitive manner. The two receptors have been found to be involved in the cannabinoid-induced CNS effects (including alterations in mood and cognition) experienced by users of marijuana. Multiple transcript variants encoding two different protein isoforms have been described for this gene. [provided by RefSeq, May 2009]. Transcript Variant: This variant (4) contains two alternate exons in the 5' UTR, compared to variant 1. Variants 1, 3, 4 and 5 all encode isoform a. This variant was designated CB1C by PubMed ID: 15289816. Sequence Note: The RefSeq transcript and protein were derived from genomic sequence to make the sequence consistent with the reference genome assembly. The genomic coordinates used for the transcript record were based on alignments and by its description in PubMed ID: 15289816. |
| CNR1 | Y | 1521 | NM_001160259 | Homo sapiens cannabinoid receptor 1 (brain) (CNR1), transcript variant 5, mRNA. | This gene encodes one of two cannabinoid receptors. The cannabinoids, principally delta-9-tetrahydrocannabinol and synthetic analogs, are psychoactive ingredients of marijuana. The cannabinoid receptors are members of the guanine-nucleotide-binding protein (G-protein) coupled receptor family, which inhibit adenylate cyclase activity in a dose-dependent, stereoselective and pertussis toxin-sensitive manner. The two receptors have been found to be involved in the cannabinoid-induced CNS effects (including alterations in mood and cognition) experienced by users of marijuana. Multiple transcript variants encoding two different protein isoforms have been described for this gene. [provided by RefSeq, May 2009]. Transcript Variant: This variant (5) uses a different splice site in the 5' UTR, compared to variant 1. Variants 1, 3, 4 and 5 all encode isoform a. This variant was designated CB1D by PubMed ID: 15289816. Sequence Note: The RefSeq transcript and protein were derived from genomic sequence to make the sequence consistent with the reference genome assembly. The genomic coordinates used for the transcript record were based on alignments. |

TABLE 4-continued

| Gene name | Exon overlap | SEQ ID No | RefSeq Accession Number | mRNA Description | RefSeq Summary |
|---|---|---|---|---|---|
| CNR1 | Y | 1522 | NM_016083 | Homo sapiens cannabinoid receptor 1 (brain) (CNR1), transcript variant 1, mRNA. | This gene encodes one of two cannabinoid receptors. The cannabinoids, principally delta-9-tetrahydrocannabinol and synthetic analogs, are psychoactive ingredients of marijuana. The cannabinoid receptors are members of the guanine-nucleotide-binding protein (G-protein) coupled receptor family, which inhibit adenylate cyclase activity in a dose-dependent, stereoselective and pertussis toxin-sensitive manner. The two receptors have been found to be involved in the cannabinoid-induced CNS effects (including alterations in mood and cognition) experienced by users of marijuana. Multiple transcript variants encoding two different protein isoforms have been described for this gene. [provided by RefSeq, May 2009]. Transcript Variant: This variant (1) encodes the longer isoform (a). Variant 1 has also been called CB1A by PubMed ID: 15289816. Variants 1, 3, 4 and 5 all encode isoform a. Sequence Note: This RefSeq record was created from transcript and genomic sequence data to make the sequence consistent with the reference genome assembly. The genomic coordinates used for the transcript record were based on transcript alignments. |
| CNR1 | Y | 1523 | NM_033181 | Homo sapiens cannabinoid receptor 1 (brain) (CNR1), transcript variant 2, mRNA. | This gene encodes one of two cannabinoid receptors. The cannabinoids, principally delta-9-tetrahydrocannabinol and synthetic analogs, are psychoactive ingredients of marijuana. The cannabinoid receptors are members of the guanine-nucleotide-binding protein (G-protein) coupled receptor family, which inhibit adenylate cyclase activity in a dose-dependent, stereoselective and pertussis toxin-sensitive manner. The two receptors have been found to be involved in the cannabinoid-induced CNS effects (including alterations in mood and cognition) experienced by users of marijuana. Multiple transcript variants encoding two different protein isoforms have been described for this gene. [provided by RefSeq, May 2009]. Transcript Variant: This variant (2) lacks an internal segment near the 5' end of the coding region, compared to variant 1. The resulting protein (isoform b) has a shorter and distinct N-terminus compared to isoform a. PubMed ID: 15620723 referred to this variant and its protein as CB1b. |
| AIM1 | Y | 1524 | NM_001624 | Homo sapiens absent in melanoma 1 (AIM1), mRNA. | N/A |
| ARMC10 | Y | 1525 | NM_001161009 | Homo sapiens armadillo repeat containing 10 (ARMC10), transcript variant B, mRNA. | This gene encodes a protein that contains an armadillo repeat and transmembrane domain. The encoded protein decreases the transcriptional activity of the tumor suppressor protein p53 through direct interaction with the DNA-binding domain of p53, and may play a role in cell growth and survival. Upregulation of this gene may play a role in hepatocellular carcinoma. Alternatively spliced transcript variants encoding multiple isoforms have been observed for this gene, and a pseudogene of this gene is located on the long arm of chromosome 3. [provided by RefSeq, September 2011]. Transcript Variant: This variant (B) lacks an in-frame exon in the 5' coding region compared to variant A. This results in a shorter protein (isoform b) compared to isoform a. |
| ARMC10 | Y | 1526 | NM_001161010 | Homo sapiens armadillo repeat containing 10 (ARMC10), transcript variant C, mRNA. | This gene encodes a protein that contains an armadillo repeat and transmembrane domain. The encoded protein decreases the transcriptional activity of the tumor suppressor protein p53 through direct interaction with the DNA-binding domain of p53, and may play a role in cell growth and survival. Upregulation of this gene may play a role in hepatocellular carcinoma. Alternatively spliced transcript variants encoding multiple isoforms have been observed for this gene, and a pseudogene of this gene is located on the long arm of chromosome 3. [provided by RefSeq, September 2011]. Transcript Variant: This variant (C) lacks an in-frame exon in the 3' coding region compared to variant A. This results in a shorter protein (isoform c) compared to isoform a. |
| ARMC10 | Y | 1527 | NM_001161011 | Homo sapiens armadillo repeat containing 10 (ARMC10), transcript variant E, mRNA. | This gene encodes a protein that contains an armadillo repeat and transmembrane domain. The encoded protein decreases the transcriptional activity of the tumor suppressor protein p53 through direct interaction with the DNA-binding domain of p53, and may play a role in cell growth and survival. Upregulation of this gene may play a role in hepatocellular carcinoma. Alternatively spliced transcript variants encoding multiple isoforms have been observed for this gene, and a pseudogene of this gene is located on the long arm of chromosome 3. [provided by RefSeq, September 2011]. Transcript |

TABLE 4-continued

| Gene name | Exon overlap | SEQ ID No | RefSeq Accession Number | mRNA Description | RefSeq Summary |
|---|---|---|---|---|---|
| ARMC10 | Y | 1528 | NM_001161012 | Homo sapiens armadillo repeat containing 10 (ARMC10), transcript variant D, mRNA. | Variant: This variant (E) lacks two in-frame exons in the coding region compared to variant A. This results in a shorter protein (isoform e) compared to isoform a. This gene encodes a protein that contains an armadillo repeat and transmembrane domain. The encoded protein decreases the transcriptional activity of the tumor suppressor protein p53 through direct interaction with the DNA-binding domain of p53, and may play a role in cell growth and survival. Upregulation of this gene may play a role in hepatocellular carcinoma. Alternatively spliced transcript variants encoding multiple isoforms have been observed for this gene, and a pseudogene of this gene is located on the long arm of chromosome 3. [provided by RefSeq, September 2011]. Transcript Variant: This variant (D) lacks two in-frame exons in the coding region compared to variant A. This results in a shorter protein (isoform d) compared to isoform a. |
| ARMC10 | Y | 1529 | NM_001161013 | Homo sapiens armadillo repeat containing 10 (ARMC10), transcript variant F, mRNA. | This gene encodes a protein that contains an armadillo repeat and transmembrane domain. The encoded protein decreases the transcriptional activity of the tumor suppressor protein p53 through direct interaction with the DNA-binding domain of p53, and may play a role in cell growth and survival. Upregulation of this gene may play a role in hepatocellular carcinoma. Alternatively spliced transcript variants encoding multiple isoforms have been observed for this gene, and a pseudogene of this gene is located on the long arm of chromosome 3. [provided by RefSeq, September 2011]. Transcript Variant: This variant (F) lacks three in-frame exons in the coding region compared to variant A. This results in a shorter protein (isoform f) compared to isoform a. |
| ARMC10 | Y | 1530 | NM_031905 | Homo sapiens armadillo repeat containing 10 (ARMC10), transcript variant A, mRNA. | This gene encodes a protein that contains an armadillo repeat and transmembrane domain. The encoded protein decreases the transcriptional activity of the tumor suppressor protein p53 through direct interaction with the DNA-binding domain of p53, and may play a role in cell growth and survival. Upregulation of this gene may play a role in hepatocellular carcinoma. Alternatively spliced transcript variants encoding multiple isoforms have been observed for this gene, and a pseudogene of this gene is located on the long arm of chromosome 3. [provided by RefSeq, September 2011]. Transcript Variant: This variant (A) represents the longest transcript and encodes the longest isoform (a). |
| FBXL13 | Y | 1531 | NM_001111038 | Homo sapiens F-box and leucine-rich repeat protein 13 (FBXL13), transcript variant 2, mRNA. | Members of the F-box protein family, such as FBXL13, are characterized by an approximately 40-amino acid F-box motif. SCF complexes, formed by SKP1 (MIM 601434), cullin (see CUL1; MIM 603134), and F-box proteins, act as protein-ubiquitin ligases. F-box proteins interact with SKP1 through the F box, and they interact with ubiquitination targets through other protein interaction domains (Jin et al., 2004 [PubMed 15520277]). [supplied by OMIM, March 2008]. Transcript Variant: This variant (2) contains a different segment in the 5' UTR and lacks an alternate in-frame segment in the 3' CDS, compared to variant 1. The resulting protein (isoform 2) is shorter when it is compared to isoform 1. |
| FBXL13 | Y | 1532 | NM_145032 | Homo sapiens F-box and leucine-rich repeat protein 13 (FBXL13), transcript variant 1, mRNA. | Members of the F-box protein family, such as FBXL13, are characterized by an approximately 40-amino acid F-box motif. SCF complexes, formed by SKP1 (MIM 601434), cullin (see CUL1; MIM 603134), and F-box proteins, act as protein-ubiquitin ligases. F-box proteins interact with SKP1 through the F box, and they interact with ubiquitination targets through other protein interaction domains (Jin et al., 2004 [PubMed 15520277]). [supplied by OMIM, March 2008]. Transcript Variant: This variant (1) is the longer transcript and it encodes the longer protein (isoform 1). |
| NAPEPLD | Y | 1533 | NM_001122838 | Homo sapiens N-acyl phosphatidylethanolamine phospholipase D (NAPEPLD), transcript variant 1, mRNA. | NAPEPLD is a phospholipase D type enzyme that catalyzes the release of N-acylethanolamine (NAE) from N-acyl-phosphatidylethanolamine (NAPE) in the second step of the biosynthesis of N-acylethanolamine (Okamoto et al., 2004 [PubMed 14634025]). [supplied by OMIM, October 2008]. Transcript Variant: This variant (1) represents the longer transcript. Variants 1 and 2 encode the same protein. Sequence Note: This RefSeq record was created from transcript and genomic sequence data because no single transcript was available for the full length of the gene. The extent of this transcript is supported by transcript alignments. |
| NAPEPLD | Y | 1534 | NM_198990 | Homo sapiens N-acyl phosphatidylethanolamine phospholipase D | NAPEPLD is a phospholipase D type enzyme that catalyzes the release of N-acylethanolamine (NAE) from N-acyl-phosphatidylethanolamine (NAPE) in the second step of the biosynthesis of N-acylethanolamine (Okamoto et al., 2004 [PubMed 14634025]). [supplied by OMIM, October 2008]. |

TABLE 4-continued

| Gene name | Exon overlap | SEQ ID No | RefSeq Accession Number | mRNA Description | RefSeq Summary |
|---|---|---|---|---|---|
| | | | | (NAPEPLD), transcript variant 2, mRNA. | Transcript Variant: This variant (2) differs in the 3′ UTR, compared to variant 1. Variants 1 and 2 encode the same protein. Sequence Note: This RefSeq record was created from transcript and genomic sequence data because no single transcript was available for the full length of the gene. The extent of this transcript is supported by transcript alignments. |
| MYOM2 | Y | 1535 | NM_003970 | Homo sapiens myomesin (M-protein) 2, 165 kDa (MYOM2), mRNA. | The giant protein titin, together with its associated proteins, interconnects the major structure of sarcomeres, the M bands and Z discs. The C-terminal end of the titin string extends into the M line, where it binds tightly to M-band constituents of apparent molecular masses of 190 kD and 165 kD. The predicted MYOM2 protein contains 1,465 amino acids. Like MYOM1, MYOM2 has a unique N-terminal domain followed by 12 repeat domains with strong homology to either fibronectin type III or immunoglobulin C2 domains. Protein sequence comparisons suggested that the MYOM2 protein and bovine M protein are identical. [provided by RefSeq, July 2008]. |
| DEFA5 | Y | 1536 | NM_021010 | Homo sapiens defensin, alpha 5, Paneth cell-specific (DEFA5), mRNA. | Defensins are a family of microbicidal and cytotoxic peptides thought to be involved in host defense. They are abundant in the granules of neutrophils and also found in the epithelia of mucosal surfaces such as those of the intestine, respiratory tract, urinary tract, and vagina. Members of the defensin family are highly similar in protein sequence and distinguished by a conserved cysteine motif. Several of the alpha defensin genes appear to be clustered on chromosome 8. The protein encoded by this gene, defensin, alpha 5, is highly expressed in the secretory granules of Paneth cells of the ileum. [provided by RefSeq, July 2008]. |
| POTEA | Y | 1537 | NM_001002920 | Homo sapiens POTE ankyrin domain family, member A (POTEA), transcript variant 1, mRNA. | N/A |
| POTEA | Y | 1538 | NM_001005365 | Homo sapiens POTE ankyrin domain family, member A (POTEA), transcript variant 2, mRNA. | N/A |
| ACACB | Y | 1539 | NM_001093 | Homo sapiens acetyl-CoA carboxylase beta (ACACB), mRNA. | Acetyl-CoA carboxylase (ACC) is a complex multifunctional enzyme system. ACC is a biotin-containing enzyme which catalyzes the carboxylation of acetyl-CoA to malonyl-CoA, the rate-limiting step in fatty acid synthesis. ACC-beta is thought to control fatty acid oxidation by means of the ability of malonyl-CoA to inhibit carnitine-palmitoyl-CoA transferase I, the rate-limiting step in fatty acid uptake and oxidation by mitochondria. ACC-beta may be involved in the regulation of fatty acid oxidation, rather than fatty acid biosynthesis. There is evidence for the presence of two ACC-beta isoforms. [provided by RefSeq, July 2008]. |
| COX6A1 | Y | 1540 | NM_004373 | Homo sapiens cytochrome c oxidase subunit VIa polypeptide 1 (COX6A1), nuclear gene encoding mitochondrial protein, mRNA. | Cytochrome c oxidase (COX), the terminal enzyme of the mitochondrial respiratory chain, catalyzes the electron transfer from reduced cytochrome c to oxygen. It is a heteromeric complex consisting of 3 catalytic subunits encoded by mitochondrial genes and multiple structural subunits encoded by nuclear genes. The mitochondrially-encoded subunits function in the electron transfer and the nuclear-encoded subunits may function in the regulation and assembly of the complex. This nuclear gene encodes polypeptide 1 (liver isoform) of subunit VIa, and polypeptide 1 is found in all non-muscle tissues. Polypeptide 2 (heart/muscle isoform) of subunit VIa is encoded by a different gene, and is present only in striated muscles. These two polypeptides share 66% amino acid sequence identity. It has been reported that there may be several pseudogenes on chromosomes 1, 6, 7q21, 7q31-32 and 12. However, only one pseudogene (COX6A1P) on chromosome 1p31.1 has been documented. [provided by RefSeq, July 2008]. |
| GATC | Y | 1541 | NM_176818 | Homo sapiens glutamyl-tRNA(Gln) amidotransferase, subunit C homolog (bacterial) | N/A |

TABLE 4-continued

| Gene name | Exon overlap | SEQ ID No | RefSeq Accession Number | mRNA Description | RefSeq Summary |
|---|---|---|---|---|---|
| GATC | Y | 1542 | NR_033684 | Homo sapiens glutamyl-tRNA(Gln) amidotransferase, subunit C homolog (bacterial) (GATC), transcript variant 2, non-coding RNA. | N/A |
| TRIAP1 | Y | 1543 | NM_016399 | Homo sapiens TP53 regulated inhibitor of apoptosis 1 (TRIAP1), mRNA. | N/A |
| CSPG4 | Y | 1544 | NM_001897 | Homo sapiens chondroitin sulfate proteoglycan 4 (CSPG4), mRNA. | A human melanoma-associated chondroitin sulfate proteoglycan plays a role in stabilizing cell-substratum interactions during early events of melanoma cell spreading on endothelial basement membranes. CSPG4 represents an integral membrane chondroitin sulfate proteoglycan expressed by human malignant melanoma cells. [provided by RefSeq, July 2008]. |
| SNUPN | Y | 1545 | NM_001042581 | Homo sapiens snurportin 1 (SNUPN), transcript variant 2, mRNA. | The nuclear import of the spliceosomal snRNPs U1, U2, U4 and U5, is dependent on the presence of a complex nuclear localization signal. The latter is composed of the 5'-2,2,7-terminal trimethylguanosine (m3G) cap structure of the U snRNA and the Sm core domain. The protein encoded by this gene interacts specifically with m3G-cap and functions as an snRNP-specific nuclear import receptor. Alternatively spliced transcript variants encoding the same protein have been identified for this gene. [provided by RefSeq, July 2008]. Transcript Variant: This variant (2) differs in the 5' UTR, compared to variant 1. Variants 1, 2 and 3 encode the same protein. |
| SNUPN | Y | 1546 | NM_001042588 | Homo sapiens snurportin 1 (SNUPN), transcript variant 3, mRNA. | The nuclear import of the spliceosomal snRNPs U1, U2, U4 and U5, is dependent on the presence of a complex nuclear localization signal. The latter is composed of the 5'-2,2,7-terminal trimethylguanosine (m3G) cap structure of the U snRNA and the Sm core domain. The protein encoded by this gene interacts specifically with m3G-cap and functions as an snRNP-specific nuclear import receptor. Alternatively spliced transcript variants encoding the same protein have been identified for this gene. [provided by RefSeq, July 2008]. Transcript Variant: This variant (3) differs in the 5' UTR, compared to variant 1. Variants 1, 2 and 3 encode the same protein. |
| SNUPN | Y | 1547 | NM_005701 | Homo sapiens snurportin 1 (SNUPN), transcript variant 1, mRNA. | The nuclear import of the spliceosomal snRNPs U1, U2, U4 and U5, is dependent on the presence of a complex nuclear localization signal. The latter is composed of the 5'-2,2,7-terminal trimethylguanosine (m3G) cap structure of the U snRNA and the Sm core domain. The protein encoded by this gene interacts specifically with m3G-cap and functions as an snRNP-specific nuclear import receptor. Alternatively spliced transcript variants encoding the same protein have been identified for this gene. [provided by RefSeq, July 2008]. Transcript Variant: This variant (1) represents the longest transcript. Variants 1, 2 and 3 encode the same protein. |
| SNX33 | Y | 1548 | NM_153271 | Homo sapiens sorting nexin 33 (SNX33), mRNA. | N/A |
| TARSL2 | Y | 1549 | NM_152334 | Homo sapiens threonyl-tRNA synthetase-like 2 (TARSL2), mRNA. | N/A |
| TM2D3 | Y | 1550 | NM_025141 | Homo sapiens TM2 domain containing 3 (TM2D3), transcript variant 2, mRNA. | The protein encoded by this gene contains a structural module related to that of the seven transmembrane domain G protein-coupled receptor superfamily. This protein has sequence and structural similarities to the beta-amyloid binding protein (BBP), but, unlike BBP, it does not regulate a response to beta-amyloid peptide. This protein may have regulatory roles in cell death or proliferation signal cascades. Several alternatively spliced transcript variants of this gene are described but the full length nature of some variants has not been determined. Multiple polyadenylation sites have been found in this gene. [provided by RefSeq, July 2008]. Transcript Variant: This variant (2) |

TABLE 4-continued

| Gene name | Exon overlap | SEQ ID No | RefSeq Accession Number | mRNA Description | RefSeq Summary |
|---|---|---|---|---|---|
| TM2D3 | Y | 1551 | NM_078474 | Homo sapiens TM2 domain containing 3 (TM2D3), transcript variant 1, mRNA. | lacks an exon within the coding region, but maintains the same reading frame, as compared to variant 1. Thus isoform b lacks an internal fragment of 26 aa compared to isoform a. The protein encoded by this gene contains a structural module related to that of the seven transmembrane domain G protein-coupled receptor superfamily. This protein has sequence and structural similarities to the beta-amyloid binding protein (BBP), but, unlike BBP, it does not regulate a response to beta-amyloid peptide. This protein may have regulatory roles in cell death or proliferation signal cascades. Several alternatively spliced transcript variants of this gene are described but the full length nature of some variants has not been determined. Multiple polyadenylation sites have been found in this gene. [provided by RefSeq, July 2008]. Transcript Variant: This variant (1) encodes the full length isoform. |
| ABCC6P1 | Y | 1552 | NR_003569 | Homo sapiens ATP-binding cassette, sub-family C, member 6 pseudogene 1 (ABCC6P1), non-coding RNA. | N/A |
| GLG1 | Y | 1553 | NM_001145666 | Homo sapiens golgi glycoprotein 1 (GLG1), transcript variant 2, mRNA. | N/A |
| GLG1 | Y | 1554 | NM_001145667 | Homo sapiens golgi glycoprotein 1 (GLG1), transcript variant 3, mRNA. | N/A |
| GLG1 | Y | 1555 | NM_012201 | Homo sapiens golgi glycoprotein 1 (GLG1), transcript variant 1, mRNA. | N/A |
| GLG1 | Y | 1556 | NR_027264 | Homo sapiens golgi glycoprotein 1 (GLG1), transcript variant 4, non-coding RNA. | N/A |
| GLG1 | Y | 1557 | NR_027265 | Homo sapiens golgi glycoprotein 1 (GLG1), transcript variant 5, non-coding RNA. | N/A |
| RPTOR | Y | 1558 | NM_001163034 | Homo sapiens regulatory associated protein of MTOR, complex 1 (RPTOR), transcript variant 2, mRNA. | This gene encodes a component of a signaling pathway that regulates cell growth in response to nutrient and insulin levels. The encoded protein forms a stoichiometric complex with the mTOR kinase, and also associates with eukaryotic initiation factor 4E-binding protein-1 and ribosomal protein S6 kinase. The protein positively regulates the mTOR kinase. Multiple transcript variants encoding different isoforms have been found for this gene. [provided by RefSeq, September 2009]. Transcript Variant: This variant (2) lacks alternate in-frame exons compared to variant 1. This results in a shorter protein (isoform 2) compared to isoform 1. The transcript is described in PMID:19388141. Sequence Note: The RefSeq transcript and protein were derived from genomic sequence to make the sequence consistent with the reference genome assembly. The genomic coordinates used for the transcript record were based on alignments. |
| RPTOR | Y | 1559 | NM_020761 | Homo sapiens regulatory associated protein of MTOR, complex 1 (RPTOR), transcript variant 1, mRNA. | This gene encodes a component of a signaling pathway that regulates cell growth in response to nutrient and insulin levels. The encoded protein forms a stoichiometric complex with the mTOR kinase, and also associates with eukaryotic initiation factor 4E-binding protein-1 and ribosomal protein S6 kinase. The protein positively regulates the downstream effector ribosomal protein S6 kinase, and negatively regulates the mTOR kinase. Multiple transcript variants encoding different isoforms have been found for this gene. [provided by RefSeq, September 2009]. Transcript Variant: This variant (1) represents the longer transcript and encodes the longer isoform (1). |

TABLE 4-continued

| Gene name | Exon overlap | SEQ ID No | RefSeq Accession Number | mRNA Description | RefSeq Summary |
|---|---|---|---|---|---|
| PPAP2C | Y | 1560 | NM_003712 | Homo sapiens phosphatidic acid phosphatase type 2C (PPAP2C), transcript variant 1, mRNA. | The protein encoded by this gene is a member of the phosphatidic acid phosphatase (PAP) family. PAPs convert phosphatidic acid to diacylglycerol, and function in de novo synthesis of glycerolipids as well as in receptor-activated signal transduction mediated by phospholipase D. This protein is similar to phosphatidic acid phosphatase type 2A (PPAP2A) and type 2B (PPAP2B). All three proteins contain 6 transmembrane regions, and a consensus N-glycosylation site. This protein has been shown to possess membrane associated PAP activity. Three alternatively spliced transcript variants encoding distinct isoforms have been reported. [provided by RefSeq, July 2008]. Transcript Variant: This variant (1) differs in the 5' region, including the 5' UTR and a part of the coding region, as compared to variant 3. The resulting isoform (1) has a distinct and shorter N-terminus, as compared to isoform 3. |
| PPAP2C | Y | 1561 | NM_177526 | Homo sapiens phosphatidic acid phosphatase type 2C (PPAP2C), transcript variant 2, mRNA. | The protein encoded by this gene is a member of the phosphatidic acid phosphatase (PAP) family. PAPs convert phosphatidic acid to diacylglycerol, and function in de novo synthesis of glycerolipids as well as in receptor-activated signal transduction mediated by phospholipase D. This protein is similar to phosphatidic acid phosphatase type 2A (PPAP2A) and type 2B (PPAP2B). All three proteins contain 6 transmembrane regions, and a consensus N-glycosylation site. This protein has been shown to possess membrane associated PAP activity. Three alternatively spliced transcript variants encoding distinct isoforms have been reported. [provided by RefSeq, July 2008]. Transcript Variant: This variant (2) differs in the 5' region, as compared to variant 3. The translation begins at a downstream start codon. The resulting isoform (2) has a shorter N-terminus, as compared to isoform 3. |
| PPAP2C | Y | 1562 | NM_177543 | Homo sapiens phosphatidic acid phosphatase type 2C (PPAP2C), transcript variant 3, mRNA. | The protein encoded by this gene is a member of the phosphatidic acid phosphatase (PAP) family. PAPs convert phosphatidic acid to diacylglycerol, and function in de novo synthesis of glycerolipids as well as in receptor-activated signal transduction mediated by phospholipase D. This protein is similar to phosphatidic acid phosphatase type 2A (PPAP2A) and type 2B (PPAP2B). All three proteins contain 6 transmembrane regions, and a consensus N-glycosylation site. This protein has been shown to possess membrane associated PAP activity. Three alternatively spliced transcript variants encoding distinct isoforms have been reported. [provided by RefSeq, July 2008]. Transcript Variant: This variant (3) encodes the longest isoform (3). |
| MIR516B2 | Y | 1563 | NR_030207 | Homo sapiens microRNA 526b-2 (MIR526B2), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MIR526A2 | Y | 1564 | NR_030208 | Homo sapiens microRNA 526a-2 (MIR526A2), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. |

TABLE 4-continued

| Gene name | Exon overlap | SEQ ID No | RefSeq Accession Number | mRNA Description | RefSeq Summary |
|---|---|---|---|---|---|
| MIR518A1 | Y | 1565 | NR_030210 | Homo sapiens microRNA 518a-1 (MIR518A1), microRNA. | [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| MIR518E | Y | 1566 | NR_030209 | Homo sapiens microRNA 518e (MIR518E), microRNA. | microRNAs (miRNAs) are short (20-24 nt) non-coding RNAs that are involved in post-transcriptional regulation of gene expression in multicellular organisms by affecting both the stability and translation of mRNAs. miRNAs are transcribed by RNA polymerase II as part of capped and polyadenylated primary transcripts (pri-miRNAs) that can be either protein-coding or non-coding. The primary transcript is cleaved by the Drosha ribonuclease III enzyme to produce an approximately 70-nt stem-loop precursor miRNA (pre-miRNA), which is further cleaved by the cytoplasmic Dicer ribonuclease to generate the mature miRNA and antisense miRNA star (miRNA*) products. The mature miRNA is incorporated into a RNA-induced silencing complex (RISC), which recognizes target mRNAs through imperfect base pairing with the miRNA and most commonly results in translational inhibition or destabilization of the target mRNA. The RefSeq represents the predicted microRNA stem-loop. [provided by RefSeq, September 2009]. Sequence Note: This record represents a predicted microRNA stem-loop as defined by miRBase. Some sequence at the 5' and 3' ends may not be included in the intermediate precursor miRNA produced by Drosha cleavage. |
| LOC440297 | Y | 1567 | NR_033579 | Homo sapiens chondroitin sulfate proteoglycan 4 pseudogene (LOC440297), non-coding RNA. | N/A |
| LOC727849 | Y | 1568 | NR_033936 | Homo sapiens golgin A2 pseudogene (LOC727849), non-coding RNA. | N/A |
| KRT39 | Y | 1569 | NM_213656 | Homo sapiens keratin 39 (KRT39), mRNA. | This gene encodes a member of the type I (acidic) keratin family, which belongs to the superfamily of intermediate filament (IF) proteins. Keratins are heteropolymeric structural proteins which form the intermediate filament. These filaments, along with actin microfilaments and microtubules, compose the cytoskeleton of epithelial cells. The type I keratin genes are clustered in a region of chromosome 17q12-q21. [provided by RefSeq, July 2009]. |
| KRT40 | Y | 1570 | NM_182497 | Homo sapiens keratin 40 (KRT40), mRNA. | This gene encodes a member of the type I (acidic) keratin family, which belongs to the superfamily of intermediate filament (IF) proteins. Keratins are heteropolymeric structural proteins which form the intermediate filament. These filaments, along with actin microfilaments and microtubules, compose the cytoskeleton of epithelial cells. The type I keratin genes are clustered in a region of chromosome 17q12-q21. [provided by RefSeq, July 2009]. Sequence Note: The RefSeq transcript and protein were derived from genomic sequence to make the sequence consistent with the reference genome assembly. The genomic coordinates used for the transcript record were based on alignments. |

TABLE 4-continued

| Gene name | Exon overlap | SEQ ID No | RefSeq Accession Number | mRNA Description | RefSeq Summary |
|---|---|---|---|---|---|
| KRTAP1-1 | Y | 1571 | NM_030967 | *Homo sapiens* keratin associated protein 1-1 (KRTAP1-1), mRNA. | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the high sulfur KAP family and the gene is localized to a cluster of KAPs at 17q12-q21. [provided by RefSeq, July 2008]. |
| KRTAP1-3 | Y | 1572 | NM_030966 | *Homo sapiens* keratin associated protein 1-3 (KRTAP1-3), mRNA. | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the high sulfur KAP family and the gene is localized to a cluster of KAPs at 17q12-q21. [provided by RefSeq, July 2008]. |
| KRTAP1-5 | Y | 1573 | NM_031957 | *Homo sapiens* keratin associated protein 1-5 (KRTAP1-5), mRNA. | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the high sulfur KAP family and the gene is localized to a cluster of KAPs at 17q12-q21. [provided by RefSeq, July 2008]. |
| KRTAP2-1 | Y | 1574 | NM_001123387 | *Homo sapiens* keratin associated protein 2-1 (KRTAP2-1), mRNA. | N/A |
| KRTAP2-2 | Y | 1575 | NM_033032 | *Homo sapiens* keratin associated protein 2-2 (KRTAP2-2), mRNA. | N/A |
| KRTAP2-4 | Y | 1576 | NM_033184 | *Homo sapiens* keratin associated protein 2-4 (KRTAP2-4), mRNA. | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the high sulfur KAP family and the gene is localized to a cluster of KAPs at 17q12-q21. [provided by RefSeq, July 2008]. |
| KRTAP3-1 | Y | 1577 | NM_031958 | *Homo sapiens* keratin associated protein 3-1 (KRTAP3-1), mRNA. | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the high sulfur KAP family and the gene is localized to a cluster of KAPs at 17q12-q21. [provided by RefSeq, July 2008]. |
| KRTAP3-2 | Y | 1578 | NM_031959 | *Homo sapiens* keratin associated protein 3-2 (KRTAP3-2), mRNA. | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the high sulfur KAP family and the gene is localized to a cluster of KAPs at 17q12-q21. [provided by RefSeq, July 2008]. |
| KRTAP3-3 | Y | 1579 | NM_033185 | *Homo sapiens* keratin associated protein 3-3 (KRTAP3-3), mRNA. | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the high sulfur KAP family and the gene is localized to a cluster of KAPs at 17q12-q21. [provided by RefSeq, July 2008]. |

TABLE 4-continued

| Gene name | Exon overlap | SEQ ID No | RefSeq Accession Number | mRNA Description | RefSeq Summary |
|---|---|---|---|---|---|
| KRTAP4-11 | Y | 1580 | NM_033059 | *Homo sapiens* keratin associated protein 4-11 (KRTAP4-11), mRNA. | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the ultrahigh sulfur KAP family and the gene is localized to a cluster of KAPs at 17q12-q21. [provided by RefSeq, March 2009]. Sequence Note: The RefSeq transcript and protein were derived from genomic sequence to make the sequence consistent with the reference genome assembly. The genomic coordinates used for the transcript record were based on alignments. |
| KRTAP4-12 | Y | 1581 | NM_031854 | *Homo sapiens* keratin associated protein 4-12 (KRTAP4-12), mRNA. | This protein is a member of the keratin-associated protein (KAP) family. The KAP proteins form a matrix of keratin intermediate filaments which contribute to the structure of hair fibers. KAP family members appear to have unique, family-specific amino- and carboxyl-terminal regions and are subdivided into three multi-gene families according to amino acid composition: the high sulfur, the ultrahigh sulfur, and the high tyrosine/glycine KAPs. This protein is a member of the ultrahigh sulfur KAP family and the gene is localized to a cluster of KAPs at 17q12-q21. [provided by RefSeq, July 2008]. |
| LOC730755 | Y | 1582 | NM_001165252 | *Homo sapiens* keratin associated protein 2-4-like (LOC730755), mRNA. | N/A |
| OLFM3 | Y | 1583 | NM_058170 | *Homo sapiens* olfactomedin 3 (OLFM3), mRNA. | N/A |
| C1orf106 | Y | 1584 | NM_001142569 | *Homo sapiens* chromosome 1 open reading frame 106 (C1orf106), transcript variant 2, mRNA. | N/A |
| C1orf106 | Y | 1585 | NM_018265 | *Homo sapiens* chromosome 1 open reading frame 106 (C1orf106), transcript variant 1, mRNA. | N/A |
| GPR25 | Y | 1586 | NM_005298 | *Homo sapiens* G protein-coupled receptor 25 (GPR25), mRNA. | N/A |
| TFB2M | Y | 1587 | NM_022366 | *Homo sapiens* transcription factor B2, mitochondrial (TFB2M), nuclear gene encoding mitochondrial protein, mRNA. | N/A |
| OR2T29 | Y | 1588 | NM_001004694 | *Homo sapiens* olfactory receptor, family 2, subfamily T, member 29 (OR2T29), mRNA. | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, July 2008]. Sequence Note: The RefSeq transcript and protein were derived from genomic sequence to make the sequence consistent with the reference genome assembly. The genomic coordinates used for the transcript record were based on homologous alignments. |
| SH3BP5L | Y | 1589 | NM_030645 | *Homo sapiens* SH3-binding domain protein 5-like (SH3BP5L), mRNA. | N/A |

TABLE 4-continued

| Gene name | Exon overlap | SEQ ID No | RefSeq Accession Number | mRNA Description | RefSeq Summary |
|---|---|---|---|---|---|
| CAPG | Y | 1590 | NM_001747 | *Homo sapiens* capping protein (actin filament), gelsolin-like (CAPG), mRNA. | This gene encodes a member of the gelsolin/villin family of actin-regulatory proteins. The encoded protein reversibly blocks the barbed ends of F-actin filaments in a Ca2+ and phosphoinositide-regulated manner, but does not sever preformed actin filaments. By capping the barbed ends of actin filaments, the encoded protein contributes to the control of actin-based motility in non-muscle cells. Alternatively spliced transcript variants have been observed, but have not been fully described. [provided by RefSeq, July 2008]. |
| ELMOD3 | Y | 1591 | NM_001135021 | *Homo sapiens* ELMO/CED-12 domain containing 3 (ELMOD3), transcript variant 2, mRNA. | N/A |
| ELMOD3 | Y | 1592 | NM_001135022 | *Homo sapiens* ELMO/CED-12 domain containing 3 (ELMOD3), transcript variant 3, mRNA. | N/A |
| ELMOD3 | Y | 1593 | NM_001135023 | *Homo sapiens* ELMO/CED-12 domain containing 3 (ELMOD3), transcript variant 4, mRNA. | N/A |
| ELMOD3 | Y | 1594 | NM_032213 | *Homo sapiens* ELMO/CED-12 domain containing 3 (ELMOD3), transcript variant 1, mRNA. | N/A |
| PTPN4 | Y | 1595 | NM_002830 | *Homo sapiens* protein tyrosine phosphatase, non-receptor type 4 (megakaryocyte) (PTPN4), mRNA. | The protein encoded by this gene is a member of the protein tyrosine phosphatase (PTP) family. PTPs are known to be signaling molecules that regulate a variety of cellular processes including cell growth, differentiation, mitotic cycle, and oncogenic transformation. This protein contains a C-terminal PTP domain and an N-terminal domain homologous to the band 4.1 superfamily of cytoskeletal-associated proteins. This PTP has been shown to interact with glutamate receptor delta 2 and epsilon subunits, and is thought to play a role in signalling downstream of the glutamate receptors through tyrosine dephosphorylation. [provided by RefSeq, July 2008]. |
| SCN3A | Y | 1596 | NM_001081676 | *Homo sapiens* sodium channel, voltage-gated, type III, alpha subunit (SCN3A), transcript variant 2, mRNA. | Voltage-gated sodium channels are transmembrane glycoprotein complexes composed of a large alpha subunit with 24 transmembrane domains and one or more regulatory beta subunits. They are responsible for the generation and propagation of action potentials in neurons and muscle. This gene encodes one member of the sodium channel alpha subunit gene family, and is found in a cluster of five alpha subunit genes on chromosome 2. Multiple transcript variants encoding different isoforms have been found for this gene. [provided by RefSeq, July 2008]. Transcript Variant: This variant (2), also known as 12v1, SCN3A-s, or the adult form, uses an alternate in-frame splice site in the central coding region, compared to variant 1, resulting in a shorter protein (isoform 2). |
| SCN3A | Y | 1597 | NM_001081677 | *Homo sapiens* sodium channel, voltage-gated, type III, alpha subunit (SCN3A), transcript variant 3, mRNA. | Voltage-gated sodium channels are transmembrane glycoprotein complexes composed of a large alpha subunit with 24 transmembrane domains and one or more regulatory beta subunits. They are responsible for the generation and propagation of action potentials in neurons and muscle. This gene encodes one member of the sodium channel alpha subunit gene family, and is found in a cluster of five alpha subunit genes on chromosome 2. Multiple transcript variants encoding different isoforms have been found for this gene. [provided by RefSeq, July 2008]. Transcript Variant: This variant (3), also known as the neonatal form, uses an alternate in-frame splice site in the central coding region and an alternate form of an exon in the 5' coding region, compared to variant 1. The resulting isoform (3) is shorter than isoform 1, and contains one amino acid substitution relative to isoform 2. |
| SCN3A | Y | 1598 | NM_006922 | *Homo sapiens* sodium channel, voltage-gated, type | Voltage-gated sodium channels are transmembrane glycoprotein complexes composed of a large alpha subunit with 24 transmembrane domains and one or more regulatory beta subunits. They are |

TABLE 4-continued

| Gene name | Exon overlap | SEQ ID No | RefSeq Accession Number | mRNA Description | RefSeq Summary |
|---|---|---|---|---|---|
| | | | | III, alpha subunit (SCN3A), transcript variant 1, mRNA. | responsible for the generation and propagation of action potentials in neurons and muscle. This gene encodes one member of the sodium channel alpha subunit gene family, and is found in a cluster of five alpha subunit genes on chromosome 2. Multiple transcript variants encoding different isoforms have been found for this gene. [provided by RefSeq, July 2008]. Transcript Variant: This variant (1), also known as 12v4, represents the longest transcript and encodes the longest isoform (1). |
| CNTN4 | Y | 1599 | NM_001206955 | Homo sapiens contactin 4 (CNTN4), transcript variant 4, mRNA. | This gene encodes a member of the contactin family of immunoglobulins. Contactins are axon-associated cell adhesion molecules that function in neuronal network formation and plasticity. The encoded protein is a glycosylphosphatidylinositol-anchored neuronal membrane protein that may play a role in the formation of axon connections in the developing nervous system. Deletion or mutation of this gene may play a role in 3p deletion syndrome and autism spectrum disorders. Alternative splicing results in multiple transcript variants. [provided by RefSeq, May 2011]. Transcript Variant: This variant (4) differs in the 5' UTR, compared to variant 1. Both variants 1 and 4 encode the same isoform (a). Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| CNTN4 | Y | 1600 | NM_001206956 | Homo sapiens contactin 4 (CNTN4), transcript variant 5, mRNA. | This gene encodes a member of the contactin family of immunoglobulins. Contactins are axon-associated cell adhesion molecules that function in neuronal network formation and plasticity. The encoded protein is a glycosylphosphatidylinositol-anchored neuronal membrane protein that may play a role in the formation of axon connections in the developing nervous system. Deletion or mutation of this gene may play a role in 3p deletion syndrome and autism spectrum disorders. Alternative splicing results in multiple transcript variants. [provided by RefSeq, May 2011]. Transcript Variant: This variant (5) differs in the 5' UTR, lacks a portion of the 5' coding region, uses a downstream in-frame start codon, and uses an alternate in-frame splice site in the central coding region, compared to variant 1. The encoded isoform (d) is shorter at the N-terminus, compared to isoform a. Sequence Note: This RefSeq record was created from transcript and genomic sequence data to make the sequence consistent with the reference genome assembly. The genomic coordinates used for the transcript record were based on transcript alignments. Publication Note: This RefSeq record includes a subset of the publications that are available for this gene. Please see the Gene record to access additional publications. |
| CNTN4 | Y | 1601 | NM_175607 | Homo sapiens contactin 4 (CNTN4), transcript variant 1, mRNA. | This gene encodes a member of the contactin family of immunoglobulins. Contactins are axon-associated cell adhesion molecules that function in neuronal network formation and plasticity. The encoded protein is a glycosylphosphatidylinositol-anchored neuronal membrane protein that may play a role in the formation of axon connections in the developing nervous system. Deletion or mutation of this gene may play a role in 3p deletion syndrome and autism spectrum disorders. Alternative splicing results in multiple transcript variants. [provided by RefSeq, May 2011]. Transcript Variant: This variant (1) encodes the longest isoform (a). Both variants 1 and 4 encode the same isoform. |
| CNTN4 | Y | 1602 | NM_175613 | Homo sapiens contactin 4 (CNTN4), transcript variant 3, mRNA. | This gene encodes a member of the contactin family of immunoglobulins. Contactins are axon-associated cell adhesion molecules that function in neuronal network formation and plasticity. The encoded protein is a glycosylphosphatidylinositol-anchored neuronal membrane protein that may play a role in the formation of axon connections in the developing nervous system. Deletion or mutation of this gene may play a role in 3p deletion syndrome and autism spectrum disorders. Alternative splicing results in multiple transcript variants. [provided by RefSeq, May 2011]. Transcript Variant: This variant (3) differs in the 5' UTR, lacks a portion of the 5' coding region, and uses a downstream in-frame start codon, compared to variant 1. The encoded isoform (c) is shorter at the N-terminus, compared to isoform a. Sequence Note: This RefSeq record was created from transcript and genomic sequence data to make the sequence consistent with the reference genome assembly. The genomic coordinates used for the transcript record were based on transcript alignments. Publication Note: This |

TABLE 4-continued

| Gene name | Exon overlap | SEQ ID No | RefSeq Accession Number | mRNA Description | RefSeq Summary |
|---|---|---|---|---|---|
| HACL1 | Y | 1603 | NM_012260 | *Homo sapiens* 2-hydroxyacyl-CoA lyase 1 (HACL1), mRNA. | RefSeq record includes a subset of the publications that are available for this gene. Please see the Gene record to access additional publications. N/A |
| TMEM158 | Y | 1604 | NM_015444 | *Homo sapiens* transmembrane protein 158 (gene/pseudogene) (TMEM158), mRNA. | Constitutive activation of the Ras pathway triggers an irreversible proliferation arrest reminiscent of replicative senescence. Transcription of this gene is upregulated in response to activation of the Ras pathway, but not under other conditions that induce senescence. The encoded protein is similar to a rat cell surface receptor proposed to function in a neuronal survival pathway. [provided by RefSeq, July 2008]. |
| PCYT1A | Y | 1605 | NM_005017 | *Homo sapiens* phosphate cytidylyltransferase 1, choline, alpha (PCYT1A), mRNA. | N/A |
| TCTEX1D2 | Y | 1606 | NM_152773 | *Homo sapiens* Tctex1 domain containing 2 (TCTEX1D2), mRNA. | N/A |
| ZDHHC19 | Y | 1607 | NM_001039617 | *Homo sapiens* zinc finger, DHHC-type containing 19 (ZDHHC19), mRNA. | N/A |
| ZNF890P | Y | 1608 | NR_034163 | *Homo sapiens* zinc finger protein 890, pseudogene (ZNF890P), non-coding RNA. | N/A |
| ZNF815 | Y | 1609 | NR_023382 | *Homo sapiens* zinc finger protein 815 (ZNF815), non-coding RNA. | N/A |
| AGR3 | Y | 1610 | NM_176813 | *Homo sapiens* anterior gradient 3 homolog (*Xenopus laevis*) (AGR3), mRNA. | N/A |
| LOC100287704 | Y | 1611 | NR_028348 | *Homo sapiens* uncharacterized LOC100287704 (LOC100287704), non-coding RNA. | N/A |
| LOC100287834 | Y | 1612 | NR_028349 | *Homo sapiens* uncharacterized LOC100287834 (LOC100287834), non-coding RNA. | N/A |
| LOC643955 | Y | 1613 | NR_003952 | *Homo sapiens* zinc finger protein 479 pseudogene (LOC643955), non-coding RNA. | N/A |
| ATP6V0E2 | Y | 1614 | NM_001100592 | *Homo sapiens* ATPase, H+ transporting V0 subunit e2 (ATP6V0E2), transcript variant 2, mRNA. | Multisubunit vacuolar-type proton pumps, or H(+)-ATPases, acidify various intracellular compartments, such as vacuoles, clathrin-coated and synaptic vesicles, endosomes, lysosomes, and chromaffin granules. H(+)-ATPases are also found in plasma membranes of specialized cells, where they play roles in urinary acidification, bone resorption, and sperm maturation. Multiple subunits form |

TABLE 4-continued

| Gene name | Exon overlap | SEQ ID No | RefSeq Accession Number | mRNA Description | RefSeq Summary |
|---|---|---|---|---|---|
| ATP6V0E2 | Y | 1615 | NM_145230 | Homo sapiens ATPase, H+ transporting V0 subunit e2 (ATP6V0E2), transcript variant 1, mRNA. | H(+)-ATPases, with proteins of the V1 class hydrolyzing ATP for energy to transport H+, and proteins of the V0 class forming an integral membrane domain through which H+ is transported. ATP6V0E2 encodes an isoform of the H(+)-ATPase V0 e subunit, an essential proton pump component (Blake-Palmer et al., 2007 [PubMed 17350184]). [supplied by OMIM, March 2008]. Transcript Variant: This variant (2) lacks an alternate segment in the 3' coding region, compared to variant 1, that causes a frameshift. The resulting protein (isoform 2) has a longer and distinct C-terminus, compared to isoform 1. Multisubunit vacuolar-type proton pumps, or H(+)-ATPases, acidify various intracellular compartments, such as vacuoles, clathrin-coated and synaptic vesicles, endosomes, lysosomes, and chromaffin granules. H(+)-ATPases are also found in plasma membranes of specialized cells, where they play roles in urinary acidification, bone resorption, and sperm maturation. Multiple subunits form H(+)-ATPases, with proteins of the V1 class hydrolyzing ATP for energy to transport H+, and proteins of the V0 class forming an integral membrane domain through which H+ is transported. ATP6V0E2 encodes an isoform of the H(+)-ATPase V0 e subunit, an essential proton pump component (Blake-Palmer et al., 2007 [PubMed 17350184]). [supplied by OMIM, March 2008]. Transcript Variant: This variant (1) represents the predominantly occurring transcript and it encodes isoform 1. |
| LOC401431 | Y | 1616 | NR_027040 | Homo sapiens uncharacterized LOC401431 (LOC401431), non-coding RNA. | N/A |
| ZNF862 | Y | 1617 | NM_001099220 | Homo sapiens zinc finger protein 862 (ZNF862), mRNA. | N/A |
| FGL1 | Y | 1618 | NM_004467 | Homo sapiens fibrinogen-like 1 (FGL1), transcript variant 1, mRNA. | Fibrinogen-like 1 is a member of the fibrinogen family. This protein is homologous to the carboxy terminus of the fibrinogen beta- and gamma- subunits which contains the four conserved cysteines of fibrinogens and fibrinogen related proteins. However, this protein lacks the platelet-binding site, cross-linking region and a thrombin-sensitive site which are necessary for fibrin clot formation. This protein may play a role in the development of hepatocellular carcinomas. Four alternatively spliced transcript variants encoding the same protein exist for this gene. [provided by RefSeq, July 2008]. Transcript Variant: This variant (1) appears to be the predominantly expressed transcript. It lacks an exon in the 5' UTR and has an alternate exon at the 5' end compared to the longest variant (4). All four variants encode the same protein. Publication Note: This RefSeq record includes a subset of the publications that are available for this gene. Please see the Gene record to access additional publications. |
| FGL1 | Y | 1619 | NM_147203 | Homo sapiens fibrinogen-like 1 (FGL1), transcript variant 2, mRNA. | Fibrinogen-like 1 is a member of the fibrinogen family. This protein is homologous to the carboxy terminus of the fibrinogen beta- and gamma- subunits which contains the four conserved cysteines of fibrinogens and fibrinogen related proteins. However, this protein lacks the platelet-binding site, cross-linking region and a thrombin-sensitive site which are necessary for fibrin clot formation. This protein may play a role in the development of hepatocellular carcinomas. Four alternatively spliced transcript variants encoding the same protein exist for this gene. [provided by RefSeq, July 2008]. Transcript Variant: This variant (2) lacks an exon in the 5' UTR compared to the longest variant (4). All four variants encode the same protein. Publication Note: This RefSeq record includes a subset of the publications that are available for this gene. Please see the Gene record to access additional publications. |
| FGL1 | Y | 1620 | NM_201552 | Homo sapiens fibrinogen-like 1 (FGL1), transcript variant 3, mRNA. | Fibrinogen-like 1 is a member of the fibrinogen family. This protein is homologous to the carboxy terminus of the fibrinogen beta- and gamma- subunits which contains the four conserved cysteines of fibrinogens and fibrinogen related proteins. However, this protein lacks the platelet-binding site, cross-linking region and a thrombin-sensitive site which are necessary for fibrin clot formation. This protein may play a role in the development of hepatocellular carcinomas. Four alternatively spliced transcript variants encoding the same protein exist for this gene. [provided by RefSeq, July 2008]. Transcript Variant: This variant (3) has an alternate exon at the 5' end compared to the longest variant (4). All |

TABLE 4-continued

| Gene name | Exon overlap | SEQ ID No | RefSeq Accession Number | mRNA Description | RefSeq Summary |
|---|---|---|---|---|---|
| FGL1 | Y | 1621 | NM_021553 | Homo sapiens fibrinogen-like 1 (FGL1), transcript variant 4, mRNA. | four variants encode the same protein. Publication Note: This RefSeq record includes a subset of the publications that are available for this gene. Please see the Gene record to access additional publications. Fibrinogen-like 1 is a member of the fibrinogen family. This protein is homologous to the carboxy terminus of the fibrinogen beta- and gamma- subunits which contains the four conserved cysteines of fibrinogens and fibrinogen related proteins. However, this protein lacks the platelet-binding site, cross-linking region and a thrombin-sensitive site which are necessary for fibrin clot formation. This protein may play a role in the development of hepatocellular carcinomas. Four alternatively spliced transcript variants encoding the same protein exist for this gene. [provided by RefSeq, July 2008]. Transcript Variant: This variant (4) represents the longest transcript. All four variants encode the same protein. Publication Note: This RefSeq record includes a subset of the publications that are available for this gene. Please see the Gene record to access additional publications. |
| MTUS1 | Y | 1622 | NM_001001924 | Homo sapiens microtubule associated tumor suppressor 1 (MTUS1), transcript variant 1, mRNA. | This gene encodes a protein which contains a C-terminal domain able to interact with the angiotensin II (AT2) receptor and a large coiled-coil region allowing dimerization. Multiple alternatively spliced transcript variants encoding different isoforms have been found for this gene. One of the transcript variants has been shown to encode a mitochondrial protein that acts as a tumor suppressor and participates in AT2 signaling pathways. Other variants may encode nuclear or transmembrane proteins but it has not been determined whether they also participate in AT2 signaling pathways. [provided by RefSeq, July 2008]. Transcript Variant: This variant (1), also known as ATIP3, encodes the longest isoform (1). Publication Note: This RefSeq record includes a subset of the publications that are available for this gene. Please see the Gene record to access additional publications. |
| MTUS1 | Y | 1623 | NM_001001925 | Homo sapiens microtubule associated tumor suppressor 1 (MTUS1), transcript variant 2, mRNA. | This gene encodes a protein which contains a C-terminal domain able to interact with the angiotensin II (AT2) receptor and a large coiled-coil region allowing dimerization. Multiple alternatively spliced transcript variants encoding different isoforms have been found for this gene. One of the transcript variants has been shown to encode a mitochondrial protein that acts as a tumor suppressor and participates in AT2 signaling pathways. Other variants may encode nuclear or transmembrane proteins but it has not been determined whether they also participate in AT2 signaling pathways. [provided by RefSeq, July 2008]. Transcript Variant: This variant (2) lacks an in-frame exon in the coding region, compared to variant 1. It encodes isoform 2 which lacks an internal segment, compared to isoform 1. Publication Note: This RefSeq record includes a subset of the publications that are available for this gene. Please see the Gene record to access additional publications. |
| MTUS1 | Y | 1624 | NM_001001931 | Homo sapiens microtubule associated tumor suppressor 1 (MTUS1), transcript variant 4, mRNA. | This gene encodes a protein which contains a C-terminal domain able to interact with the angiotensin II (AT2) receptor and a large coiled-coil region allowing dimerization. Multiple alternatively spliced transcript variants encoding different isoforms have been found for this gene. One of the transcript variants has been shown to encode a mitochondrial protein that acts as a tumor suppressor and participates in AT2 signaling pathways. Other variants may encode nuclear or transmembrane proteins but it has not been determined whether they also participate in AT2 signaling pathways. [provided by RefSeq, July 2008]. Transcript Variant: This variant (4), also known as ATIP4, lacks several 5' exons but has an alternate 5' exon, compared to variant 1. It encodes isoform 4 which has a much shorter and distinct N-terminus, compared to isoform 1. Publication Note: This RefSeq record includes a subset of the publications that are available for this gene. Please see the Gene record to access additional publications. |
| MTUS1 | Y | 1625 | NM_001166393 | Homo sapiens microtubule associated tumor suppressor 1 (MTUS1), transcript variant 6, mRNA. | This gene encodes a protein which contains a C-terminal domain able to interact with the angiotensin II (AT2) receptor and a large coiled-coil region allowing dimerization. Multiple alternatively spliced transcript variants encoding different isoforms have been found for this gene. One of the transcript variants has been shown to encode a mitochondrial protein that acts as a tumor suppressor and participates in AT2 signaling pathways. Other variants may encode nuclear or transmembrane proteins but it has not been determined whether they also participate in AT2 signaling pathways. [provided by RefSeq, July 2008]. Transcript Variant: This variant (6), also known as ATIP2, lacks several 5' exons |

TABLE 4-continued

| Gene name | Exon overlap | SEQ ID No | RefSeq Accession Number | mRNA Description | RefSeq Summary |
|---|---|---|---|---|---|
| MTUS1 | Y | 1626 | NM_020749 | *Homo sapiens* microtubule associated tumor suppressor 1 (MTUS1), nuclear gene encoding mitochondrial protein, transcript variant 5, mRNA. | but has an alternate 5' exon, compared to variant 1. It encodes isoform 6 which has a much shorter and distinct N-terminus, compared to isoform 1. Publication Note: This RefSeq record includes a subset of the publications that are available for this gene. Please see the Gene record to access additional publications. This gene encodes a protein which contains a C-terminal domain able to interact with the angiotensin II (AT2) receptor and a large coiled-coil region allowing dimerization. Multiple alternatively spliced transcript variants encoding different isoforms have been found for this gene. One of the transcript variants has been shown to encode a mitochondrial protein that acts as a tumor suppressor and participates in AT2 signaling pathways. Other variants may encode nuclear or transmembrane proteins but it has not been determined whether they also participate in AT2 signaling pathways. [provided by RefSeq, July 2008]. Transcript Variant: This variant (5), also known as ATIP1, lacks multiple 5' exons but has an alternate 5' exon, compared to variant 1. It encodes the shortest isoform (5) which has a much shorter and distinct N-terminus, compared to isoform 1. Isoform 5 is a mitochondrial protein. Publication Note: This RefSeq record includes a subset of the publications that are available for this gene. Please see the Gene record to access additional publications. |
| ACER2 | Y | 1627 | NM_001010887 | *Homo sapiens* alkaline ceramidase 2 (ACER2), mRNA. | The sphingolipid metabolite sphingosine-1-phosphate promotes cell proliferation and survival, whereas its precursor, sphingosine, has the opposite effect. The ceramidase ACER2 hydrolyzes very long chain ceramides to generate sphingosine (Xu et al., 2006 [PubMed 16940153]). [supplied by OMIM, July 2010]. |
| NTNG2 | Y | 1628 | NM_032536 | *Homo sapiens* netrin G2 (NTNG2), mRNA. | N/A |
| GTF3C4 | Y | 1629 | NM_012204 | *Homo sapiens* general transcription factor IIIC, polypeptide 4, 90 kDa (GTF3C4), mRNA. | N/A |
| KIAA1217 | Y | 1630 | NM_001098500 | *Homo sapiens* KIAA1217 (KIAA1217), transcript variant 2, mRNA. | N/A |
| KIAA1217 | Y | 1631 | NM_001098501 | *Homo sapiens* KIAA1217 (KIAA1217), transcript variant 3, mRNA. | N/A |
| KIAA1217 | Y | 1632 | NM_019590 | *Homo sapiens* KIAA1217 (KIAA1217), transcript variant 1, mRNA. | N/A |
| PRINS | Y | 1633 | NR_023388 | *Homo sapiens* psoriasis associated RNA induced by stress (non-protein coding) (PRINS), non-coding RNA. | N/A |
| CSGALNACT2 | Y | 1634 | NM_018590 | *Homo sapiens* chondroitin sulfate N-acetyl-galactosaminyltransferase 2 (CSGALNACT2), mRNA. | N/A |
| RASGEF1A | Y | 1635 | NM_145313 | *Homo sapiens* RasGEF domain family, member 1A (RASGEF1A), mRNA. | N/A |
| RET | Y | 1636 | NM_020630 | *Homo sapiens* ret proto-oncogene (RET), transcript variant 4, mRNA. | This gene, a member of the cadherin superfamily, encodes one of the receptor tyrosine kinases, which are cell-surface molecules that transduce signals for cell growth and differentiation. This gene plays a crucial role in neural crest development, and it can undergo oncogenic activation in vivo and in vitro by cytogenetic rearrangement. Mutations in this gene are associated with the disorders multiple |

TABLE 4-continued

| Gene name | Exon overlap | SEQ ID No | RefSeq Accession Number | mRNA Description | RefSeq Summary |
|---|---|---|---|---|---|
| RET | Y | 1637 | NM_020975 | Homo sapiens ret proto-oncogene (RET), transcript variant 2, mRNA. | endocrine neoplasia, type IIA, multiple endocrine neoplasia, type IIB, Hirschsprung disease, and medullary thyroid carcinoma. Two transcript variants encoding different isoforms have been found for this gene. Additional transcript variants have been described but their biological validity has not been confirmed. [provided by RefSeq, July 2008]. Transcript Variant: This variant (4) differs in the 3' UTR and coding region compared to variant 2. The resulting isoform (c) is shorter and has a distinct C-terminus compared to isoform a. This isoform is also known as Ret9. This gene, a member of the cadherin superfamily, encodes one of the receptor tyrosine kinases, which are cell-surface molecules that transduce signals for cell growth and differentiation. This gene plays a crucial role in neural crest development, and it can undergo oncogenic activation in vivo and in vitro by cytogenetic rearrangement. Mutations in this gene are associated with the disorders multiple endocrine neoplasia, type IIA, multiple endocrine neoplasia, type IIB, Hirschsprung disease, and medullary thyroid carcinoma. Two transcript variants encoding different isoforms have been found for this gene. Additional transcript variants have been described but their biological validity has not been confirmed. [provided by RefSeq, July 2008]. Transcript Variant: This variant (2) represents the longer transcript and encodes the longer isoform (a). This isoform is also known as Ret51. |
| CTNNA3 | Y | 1638 | NM_001127384 | Homo sapiens catenin (cadherin-associated protein), alpha 3 (CTNNA3), transcript variant 2, mRNA. | N/A |
| CTNNA3 | Y | 1639 | NM_013266 | Homo sapiens catenin (cadherin-associated protein), alpha 3 (CTNNA3), transcript variant 1, mRNA. | N/A |
| OR4C46 | Y | 1640 | NM_001004703 | Homo sapiens olfactory receptor, family 4, subfamily C, member 46 (OR4C46), mRNA. | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. [provided by RefSeq, July 2008]. |
| OR7E5P | Y | 1641 | NR_027688 | Homo sapiens olfactory receptor, family 7, subfamily E, member 5 pseudogene (OR7E5P), non-coding RNA. | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory receptor gene family is the largest in the genome. The nomenclature assigned to the olfactory receptor genes and proteins for this organism is independent of other organisms. This family member is believed to be a pseudogene. [provided by RefSeq, June 2009]. Sequence Note: This RefSeq record was created from transcript and genomic sequence data to make the sequence consistent with the reference genome assembly. The genomic coordinates used for the transcript record were based on transcript alignments. |
| OR8B2 | Y | 1642 | NM_001005468 | Homo sapiens olfactory receptor, family 8, subfamily B, member 2 (OR8B2), mRNA. | Olfactory receptors interact with odorant molecules in the nose, to initiate a neuronal response that triggers the perception of a smell. The olfactory receptor proteins are members of a large family of G-protein-coupled receptors (GPCR) arising from single coding-exon genes. Olfactory receptors share a 7-transmembrane domain structure with many neurotransmitter and hormone receptors and are responsible for the recognition and G protein-mediated transduction of odorant signals. The olfactory |

TABLE 4-continued

| Gene name | Exon overlap | SEQ ID No | RefSeq Accession Number | mRNA Description | RefSeq Summary |
|---|---|---|---|---|---|
| PGAM5 | Y | 1643 | NM_001170543 | *Homo sapiens* phosphoglycerate mutase family member 5 (PGAM5), nuclear gene encoding mitochondrial protein, transcript variant 1, mRNA. | receptor gene family is the largest in the genome. The nomenclature assigned to the olfactory receptor genes and proteins for this organism is independent of other organisms. [provided by RefSeq, July 2008]. N/A |
| PGAM5 | Y | 1644 | NM_001170544 | *Homo sapiens* phosphoglycerate mutase family member 5 (PGAM5), nuclear gene encoding mitochondrial protein, transcript variant 2, mRNA. | N/A |
| PGAM5 | Y | 1645 | NM_138575 | *Homo sapiens* phosphoglycerate mutase family member 5 (PGAM5), nuclear gene encoding mitochondrial protein, transcript variant 3, mRNA. | N/A |
| DNAJC15 | Y | 1646 | NM_013238 | *Homo sapiens* DnaJ (Hsp40) homolog, subfamily C, member 15 (DNAJC15), mRNA. | N/A |
| ENOX1 | Y | 1647 | NM_001127615 | *Homo sapiens* ecto-NOX disulfide-thiol exchanger 1 (ENOX1), transcript variant 2, mRNA. | Electron transport pathways are generally associated with mitochondrial membranes, but non-mitochondrial pathways are also biologically significant. Plasma membrane electron transport pathways are involved in functions as diverse as cellular defense, intracellular redox homeostasis, and control of cell growth and survival. Members of the ecto-NOX family, such as CNOX, or ENOX1, are involved in plasma membrane transport pathways. These enzymes exhibit both a hydroquinone (NADH) oxidase activity and a protein disulfide-thiol interchange activity in series, with each activity cycling every 22 to 26 minutes (Scarlett et al., 2005 [PubMed 15882838]). [supplied by OMIM, March 2008]. Transcript Variant: This variant (2) differs in the 5' UTR compared to variant 1. Variants 1, 2 and 3 encode the same protein. |
| ENOX1 | Y | 1648 | NM_001242863 | *Homo sapiens* ecto-NOX disulfide-thiol exchanger 1 (ENOX1), transcript variant 3, mRNA. | Electron transport pathways are generally associated with mitochondrial membranes, but non-mitochondrial pathways are also biologically significant. Plasma membrane electron transport pathways are involved in functions as diverse as cellular defense, intracellular redox homeostasis, and control of cell growth and survival. Members of the ecto-NOX family, such as CNOX, or ENOX1, are involved in plasma membrane transport pathways. These enzymes exhibit both a hydroquinone (NADH) oxidase activity and a protein disulfide-thiol interchange activity in series, with each activity cycling every 22 to 26 minutes (Scarlett et al., 2005 [PubMed 15882838]). [supplied by OMIM, March 2008]. Transcript Variant: This variant (3) differs in the 5' UTR compared to variant 1. Variants 1, 2 and 3 encode the same protein. Sequence Note: This RefSeq record was created from transcript and genomic sequence data to make the sequence consistent with the reference genome assembly. The genomic coordinates used for the transcript record were based on transcript alignments. |
| ENOX1 | Y | 1649 | NM_017993 | *Homo sapiens* ecto-NOX disulfide-thiol exchanger 1 (ENOX1), transcript variant 1, mRNA. | Electron transport pathways are generally associated with mitochondrial membranes, but non-mitochondrial pathways are also biologically significant. Plasma membrane electron transport pathways are involved in functions as diverse as cellular defense, intracellular redox homeostasis, and control of cell growth and survival. Members of the ecto-NOX family, such as CNOX, or ENOX1, are involved in plasma membrane transport pathways. These enzymes exhibit both a hydroquinone |

TABLE 4-continued

| Gene name | Exon overlap | SEQ ID No | RefSeq Accession Number | mRNA Description | RefSeq Summary |
|---|---|---|---|---|---|
| MCF2L | Y | 1650 | NM_001112732 | Homo sapiens MCF.2 cell line derived transforming sequence-like (MCF2L), transcript variant 1, mRNA. | (NADH) oxidase activity and a protein disulfide-thiol interchange activity in series, with each activity cycling every 22 to 26 minutes (Scarlett et al., 2005 [PubMed 15882838]). [supplied by OMIM, March 2008]. Transcript Variant: This variant (1) represents the longest transcript. Variants 1, 2 and 3 encode the same protein. Sequence Note: This RefSeq record was created from transcript and genomic sequence data to make the sequence consistent with the reference genome assembly. The genomic coordinates used for the transcript record were based on transcript alignments. |
| MCF2L | Y | 1651 | NM_024979 | Homo sapiens MCF.2 cell line derived transforming sequence-like (MCF2L), transcript variant 2, mRNA. | N/A |
| RASA3 | & | 1652 | NM_007368 | Homo sapiens RAS p21 protein activator 3 (RASA3), mRNA. | The protein encoded by this gene is member of the GAP1 family of GTPase-activating proteins. The gene product stimulates the GTPase activity of normal RAS p21 but not its oncogenic counterpart. Acting as a suppressor of RAS function, the protein enhances the weak intrinsic GTPase activity of RAS proteins resulting in the inactive GDP-bound form of RAS, thereby allowing control of cellular proliferation and differentiation. This family member is an inositol 1,3,4,5-tetrakisphosphate-binding protein, like the closely related RAS p21 protein activator 2. The two family members have distinct pleckstrin-homology domains, with this particular member having a domain consistent with its localization to the plasma membrane. [provided by RefSeq, July 2008]. |
| APBA2 | Y | 1653 | NM_001130414 | Homo sapiens amyloid beta (A4) precursor protein-binding, family A, member 2 (APBA2), transcript variant 2, mRNA. | The protein encoded by this gene is a member of the X11 protein family. It is a neuronal adapter protein that interacts with the Alzheimer's disease amyloid precursor protein (APP). It stabilizes APP and inhibits production of proteolytic APP fragments including the A beta peptide that is deposited in the brains of Alzheimer's disease patients. This gene product is believed to be involved in signal transduction processes. It is also regarded as a putative vesicular trafficking protein in the brain that can form a complex with the potential to couple synaptic vesicle exocytosis to neuronal cell adhesion. Multiple transcript variants encoding different isoforms have been found for this gene. [provided by RefSeq, July 2008]. Transcript Variant: This variant (2) lacks an alternate in-frame exon, compared to variant 1, resulting in a shorter protein (isoform b), compared to isoform a. Publication Note: This RefSeq record includes a subset of the publications that are available for this gene. Please see the Gene record to access additional publications. |
| APBA2 | Y | 1654 | NM_005503 | Homo sapiens amyloid beta (A4) precursor protein-binding, family A, member 2 (APBA2), transcript variant 1, mRNA. | The protein encoded by this gene is a member of the X11 protein family. It is a neuronal adapter protein that interacts with the Alzheimer's disease amyloid precursor protein (APP). It stabilizes APP and inhibits production of proteolytic APP fragments including the A beta peptide that is deposited in the brains of Alzheimer's disease patients. This gene product is believed to be involved in signal transduction processes. It is also regarded as a putative vesicular trafficking protein in the brain that can form a complex with the potential to couple synaptic vesicle exocytosis to neuronal cell adhesion. Multiple transcript variants encoding different isoforms have been found for this gene. [provided by RefSeq, July 2008]. Transcript Variant: This variant (1) represents the longest transcript and encodes the longest isoform (a). Publication Note: This RefSeq record includes a subset of the publications that are available for this gene. Please see the Gene record to access additional publications. |
| CIB2 | Y | 1655 | NM_006383 | Homo sapiens calcium and integrin binding family member 2 (CIB2), mRNA. | The amino acid sequence the protein encoded by this gene is similar to that of KIP/CIB, calcineurin B, and calmodulin. This suggests that the encoded protein may be a Ca2+-binding regulatory protein that interacts with DNA-dependent protein kinase catalytic subunit (DNA-PKcs). [provided by RefSeq, July 2008]. |
| TM4SF5 | Y | 1656 | NM_003963 | Homo sapiens transmembrane 4 L six family member 5 | The protein encoded by this gene is a member of the transmembrane 4 superfamily, also known as the tetraspanin family. Most of these members are cell-surface proteins that are characterized by the presence of four hydrophobic domains. The proteins mediate signal transduction events that play a role |

TABLE 4-continued

| Gene name | Exon overlap | SEQ ID No | RefSeq Accession Number | mRNA Description | RefSeq Summary |
|---|---|---|---|---|---|
| | | | | (TM4SF5), mRNA. | in the regulation of cell development, activation, growth and motility. This encoded protein is a cell surface glycoprotein and is highly similar in sequence and structure to transmembrane 4 superfamily member 1. It may play a role in cell proliferation, and overexpression of this protein may be associated with the uncontrolled growth of tumour cells. [provided by RefSeq, July 2008]. |
| ADAM11 | Y | 1657 | NM_002390 | Homo sapiens ADAM metallopeptidase domain 11 (ADAM11), mRNA. | This gene encodes a member of the ADAM (a disintegrin and metalloprotease) protein family. Members of this family are membrane-anchored proteins structurally related to snake venom disintegrins, and have been implicated in a variety of biological processes involving cell-cell and cell-matrix interactions, including fertilization, muscle development, and neurogenesis. This gene represents a candidate tumor supressor gene for human breast cancer based on its location within a minimal region of chromosome 17q21 previously defined by tumor deletion mapping. [provided by RefSeq, July 2008]. |
| IL27RA | Y | 1658 | NM_004843 | Homo sapiens interleukin 27 receptor, alpha (IL27RA), mRNA. | In mice, CD4+ helper T-cells differentiate into type 1 (Th1) cells, which are critical for cell-mediated immunity, predominantly under the influence of IL12. Also, IL4 influences their differentiation into type 2 (Th2) cells, which are critical for most antibody responses. Mice deficient in these cytokines, their receptors, or associated transcription factors have impaired, but are not absent of, Th1 or Th2 immune responses. This gene encodes a protein which is similar to the mouse T-cell cytokine receptor Tccr at the amino acid level, and is predicted to be a glycosylated transmembrane protein. [provided by RefSeq, July 2008]. |
| RLN3 | Y | 1659 | NM_080864 | Homo sapiens relaxin 3 (RLN3), mRNA. | Relaxins are known endocrine and autocrine/paracrine hormones, belonging to the insulin gene superfamily. In the human there are three non-allelic relaxin genes, RLN1, RLN2 and RLN3. RLN1 and RLN2 share high sequence homology. Relaxin is produced by the ovary, and targets the mammalian reproductive system to ripen the cervix, elongate the pubic symphysis and inhibit uterine contraction. It may have additional roles in enhancing sperm motility, regulating blood pressure, controlling heart rate and releasing oxytocin and vasopressin. The protein encoded by this gene is a member of the relaxin family. The active form of the encoded protein consists of an A chain and a B chain but their cleavage sites are not definitely described yet. It may play a role in neuropeptide signaling processes. [provided by RefSeq, July 2008]. |
| CD177 | Y | 1660 | NM_020406 | Homo sapiens CD177 molecule (CD177), mRNA. | NB1, a glycosyl-phosphatidylinositol (GPI)-linked N-glycosylated cell surface glycoprotein, was first described in a case of neonatal alloimmune neutropenia (Lalezari et al., 1971 [PubMed 5552408]). [supplied by OMIM, March 2008]. Publication Note: This RefSeq record includes a subset of the publications that are available for this gene. Please see the Gene record to access additional publications. |
| PRG1 | Y | 1661 | NR_026881 | Homo sapiens p53-responsive gene 1 (PRG1), non-coding RNA. | N/A |
| LILRB4 | Y | 1662 | NM_001081438 | Homo sapiens leukocyte immunoglobulin-like receptor, subfamily B (with TM and ITIM domains), member 4 (LILRB4), transcript variant 2, mRNA. | This gene is a member of the leukocyte immunoglobulin-like receptor (LIR) family, which is found in a gene cluster at chromosomal region 19q13.4. The encoded protein belongs to the subfamily B class of LIR receptors which contain two or four extracellular immunoglobulin domains, a transmembrane domain, and two to four cytoplasmic immunoreceptor tyrosine-based inhibitory motifs (ITIMs). The receptor is expressed on immune cells where it binds to MHC class I molecules on antigen-presenting cells and transduces a negative signal that inhibits stimulation of an immune response. The receptor can also function in antigen capture and presentation. It is thought to control inflammatory responses and cytotoxicity to help focus the immune response and limit autoreactivity. Multiple transcript variants encoding different isoforms have been found for this gene. [provided by RefSeq, July 2008]. Transcript Variant: This variant (2) uses an alternate in-frame splice site in the 3' coding region, compared to variant 1, resulting in a protein (isoform 2) that is 1 aa shorter than isoform 1. |
| LILRB4 | Y | 1663 | NM_006847 | Homo sapiens leukocyte immunoglobulin-like receptor, subfamily B (with | This gene is a member of the leukocyte immunoglobulin-like receptor (LIR) family, which is found in a gene cluster at chromosomal region 19q13.4. The encoded protein belongs to the subfamily B class of LIR receptors which contain two or four extracellular immunoglobulin domains, a transmembrane |

TABLE 4-continued

| Gene name | Exon overlap | SEQ ID No | RefSeq Accession Number | mRNA Description | RefSeq Summary |
|---|---|---|---|---|---|
| | | | | TM and ITIM domains), member 4 (LILRB4), transcript variant 1, mRNA. | domain, and two to four cytoplasmic immunoreceptor tyrosine-based inhibitory motifs (ITIMs). The receptor is expressed on immune cells where it binds to MHC class I molecules on antigen-presenting cells and transduces a negative signal that inhibits stimulation of an immune response. The receptor can also function in antigen capture and presentation. It is thought to control inflammatory responses and cytotoxicity to help focus the immune response and limit autoreactivity. Multiple transcript variants encoding different isoforms have been found for this gene. [provided by RefSeq, July 2008]. Transcript Variant: This variant (1) represents the longer transcript and encodes the longer isoform (1). |
| SLC27A5 | Y | 1664 | NM_012254 | *Homo sapiens* solute carrier family 27 (fatty acid transporter), member 5 (SLC27A5), mRNA. | The protein encoded by this gene is an isozyme of very long-chain acyl-CoA synthetase (VLCS). It is capable of activating very long-chain fatty-acids containing 24- and 26-carbons. It is expressed in liver and associated with endoplasmic reticulum but not with peroxisomes. Its primary role is in fatty acid elongation or complex lipid synthesis rather than in degradation. This gene has a mouse ortholog. [provided by RefSeq, July 2008]. |
| C21orf58 | Y | 1665 | NM_058180 | *Homo sapiens* chromosome 21 open reading frame 58 (C21orf58), mRNA. | N/A |
| PCNT | Y | 1666 | NM_006031 | *Homo sapiens* pericentrin (PCNT), mRNA. | The protein encoded by this gene binds to calmodulin and is expressed in the centrosome. It is an integral component of the pericentriolar material (PCM). The protein contains a series of coiled-coil domains and a highly conserved PCM targeting motif called the PACT domain near its C-terminus. The protein interacts with the microtubule nucleation component gamma-tubulin and is likely important to normal functioning of the centrosomes, cytoskeleton, and cell-cycle progression. Mutations in this gene cause Seckel syndrome-4 and microcephalic osteodysplastic primordial dwarfism type II. [provided by RefSeq, July 2008]. Publication Note: This RefSeq record includes a subset of the publications that are available for this gene. Please see the Gene record to access additional publications. |
| ZMAT5 | Y | 1667 | NM_001003692 | *Homo sapiens* zinc finger, matrin-type 5 (ZMAT5), transcript variant 2, mRNA. | N/A |
| ZMAT5 | Y | 1668 | NM_019103 | *Homo sapiens* zinc finger, matrin-type 5 (ZMAT5), transcript variant 1, mRNA. | N/A |
| ANUBL1 | Y | 1669 | NM_001128324 | *Homo sapiens* zinc finger, AN1-type domain 4 (ZFAND4), transcript variant 2, mRNA. | N/A |
| ANUBL1 | Y | 1670 | NM_174890 | *Homo sapiens* zinc finger, AN1-type domain 4 (ZFAND4), transcript variant 1, mRNA. | N/A |
| C14orf145 | N | 1671 | NM_152446 | *Homo sapiens* centrosomal protein 128 kDa (CEP128), mRNA. | N/A |
| C1orf152 | Y | 1672 | NR_003242 | *Homo sapiens* profilin 1 pseudogene 2 (PFN1P2), non-coding RNA. | N/A |
| C6orf204 | both | 1673 | NM_001042475 | *Homo sapiens* centrosomal protein 85 kDa-like (CEP85L), transcript variant 1, mRNA. | The protein encoded by this gene was identified as a breast cancer antigen. Nothing more is known of its function at this time. Three transcript variants encoding different isoforms have been found for this gene. [provided by RefSeq, May 2010]. Transcript Variant: This variant (1) represents the longest transcript. Sequence Note: This RefSeq record was created from transcript and genomic sequence data |

TABLE 4-continued

| Gene name | SEQ ID No | RefSeq Accession Number | mRNA Description | Exon overlap | RefSeq Summary |
|---|---|---|---|---|---|
| C6orf204 | 1674 | NM_001178035 | Homo sapiens centrosomal protein 85 kDa-like (CEP85L), transcript variant 3, mRNA. | both | to make the sequence consistent with the reference genome assembly. The genomic coordinates used for the transcript record were based on transcript alignments. The protein encoded by this gene was identified as a breast cancer antigen. Nothing more is known of its function at this time. Three transcript variants encoding different isoforms have been found for this gene. [provided by RefSeq, May 2010]. Transcript Variant: This variant (3) differs in the 5' UTR and coding sequence compared to variant 1. The resulting isoform (c) has a longer and distinct N-terminus compared to isoform a. Sequence Note: This RefSeq record was created from transcript and genomic sequence data to make the sequence consistent with the reference genome assembly. The genomic coordinates used for the transcript record were based on transcript alignments. |
| C6orf204 | 1675 | NM_206921 | Homo sapiens centrosomal protein 85 kDa-like (CEP85L), transcript variant 2, mRNA. | both | The protein encoded by this gene was identified as a breast cancer antigen. Nothing more is known of its function at this time. Three transcript variants encoding different isoforms have been found for this gene. [provided by RefSeq, May 2010]. Transcript Variant: This variant (2) differs in the 3' UTR and coding sequence compared to variant 1. The resulting isoform (b) has a shorter and distinct C-terminus compared to isoform a. |
| CAMSAP1L1 | 1676 | NM_203459 | Homo sapiens calmodulin regulated spectrin-associated protein family, member 2 (CAMSAP2), mRNA. | Y | N/A |
| CEP110 | 1677 | NM_007018 | Homo sapiens centriolin (CNTRL), mRNA. | N | This gene encodes a centrosomal protein required for the centrosome to function as a microtubule organizing center. The gene product is also associated with centrosome maturation. One version of stem cell myeloproliferative disorder is the result of a reciprocal translocation between chromosomes 8 and 9, with the breakpoint associated with fibroblast growth factor receptor 1 and centrosomal protein 1. [provided by RefSeq, July 2008]. |
| HERV-V1 | 1678 | NM_152473 | Homo sapiens endogenous retrovirus group V, member 1 (ERVV-1), mRNA. | Y | N/A |
| LOC100129827 | 1679 | NR_034093 | Homo sapiens MRVI1 antisense RNA 1 (non-protein coding) (MRVI1-AS1), non-coding RNA. | Y | N/A |
| LOC100129827 | 1680 | NR_034094 | Homo sapiens MRVI1 antisense RNA 1 (non-protein coding) (MRVI1-AS1), non-coding RNA. | Y | N/A |
| LOC342346 | 1681 | NM_001145011 | Homo sapiens chromosome 16 open reading frame 96 (C16orf96), mRNA. | Y | N/A |
| LOC80154 | 1682 | NR_026811 | Homo sapiens golgin subfamily A member 2-like (AGSK1), non-coding RNA. | Y | N/A |
| NAT15 | 1683 | NM_001083600 | Homo sapiens N(alpha)-acetyltransferase 60, NatF catalytic subunit (NAA60), transcript variant 3, mRNA. | Y | N/A |
| NAT15 | 1684 | NM_001083601 | Homo sapiens N(alpha)-acetyltransferase 60, NatF catalytic subunit (NAA60), transcript variant 1, mRNA. | Y | N/A |

TABLE 4-continued

| Gene name | Exon overlap | SEQ ID No | RefSeq Accession Number | mRNA Description | RefSeq Summary |
|---|---|---|---|---|---|
| NAT15 | Y | 1685 | NM_024845 | *Homo sapiens* N(alpha)-acetyltransferase 60, NatF catalytic subunit (NAA60), transcript variant 2, mRNA. | N/A |
| NCRNA00029 | Y | 1686 | NR_028295 | *Homo sapiens* long intergenic non-protein coding RNA 29 (LINC00029), non-coding RNA. | N/A |
| NCRNA00115 | Y | 1687 | NR_024321 | *Homo sapiens* long intergenic non-protein coding RNA 115 (LINC00115), non-coding RNA. | N/A |
| NCRNA00183 | N | 1688 | NR_024582 | *Homo sapiens* JPX transcript, XIST activator (non-protein coding) (JPX), non-coding RNA. | JPX is a nonprotein-coding RNA transcribed from a gene within the X-inactivation center (XIC; MIM 314670) that appears to participate in X chromosome inactivation (Tian et al., 2010 [PubMed 21029862]). [supplied by OMIM, February 2011]. |
| PBMUCL1 | Y | 1689 | NM_001198815 | *Homo sapiens* mucin 22 (MUC22), mRNA. | N/A |
| TUBB4Q | Y | 1690 | NM_020040 | *Homo sapiens* tubulin, beta polypeptide 4, member Q, pseudogene (TUBB4Q), mRNA | N/A |

TABLE 5

| Chromosome number in Table 1 and Table 2 | Actual Chromosome |
|---|---|
| 1 | chr1 |
| 2 | chr2 |
| 3 | chr3 |
| 4 | chr4 |
| 5 | chr5 |
| 6 | chr6 |
| 7 | chr7 |
| 8 | chr8 |
| 9 | chr9 |
| 10 | chr10 |
| 11 | chr11 |
| 12 | chr12 |
| 13 | chr13 |
| 14 | chr14 |
| 15 | chr15 |
| 16 | chr16 |
| 17 | chr17 |
| 18 | chr18 |
| 19 | chr19 |
| 20 | chr20 |
| 21 | chr21 |
| 22 | chr22 |
| 23 | chrX |
| 24 | chrY |
| 25 | chrM |
| 26 | chr1_random |
| 27 | chr2_random |
| 28 | chr3_random |
| 29 | chr4_random |
| 30 | chr5_random |
| 31 | chr6_random |
| 32 | chr7_random |
| 33 | chr8_random |
| 34 | chr9_random |
| 35 | chr10_random |
| 36 | chr11_random |
| 37 | chr12_random |
| 38 | chr13_random |
| 39 | chr14_random |
| 40 | chr15_random |
| 41 | chr16_random |
| 42 | chr17_random |
| 43 | chr18_random |
| 44 | chr19_random |
| 45 | chr20_random |
| 46 | chr21_random |
| 47 | chr22_random |
| 48 | chrX_random |

Computer-Implemented Aspects

As understood by those of ordinary skill in the art, the methods and information described herein (genetic variation association with developmental disorders) can be implemented, in all or in part, as computer executable instructions on known computer readable media. For example, the methods described herein can be implemented in hardware. Alternatively, the method can be implemented in software stored in, for example, one or more memories or other computer readable medium and implemented on one or more processors. As is known, the processors can be associated with one or more controllers, calculation units and/or other units of a computer system, or implanted in firmware as desired. If implemented in software, the routines can be stored in any computer readable memory such as in RAM, ROM, flash memory, a magnetic disk, a laser disk, or other storage medium, as is also known. Likewise, this software can be delivered to a computing device via any known delivery method including, for example, over a communication channel such as a telephone line, the Internet, a wireless connection, etc., or via a transportable medium, such as a computer readable disk, flash drive, etc.

More generally, and as understood by those of ordinary skill in the art, the various steps described above can be implemented as various blocks, operations, tools, modules and techniques which, in turn, can be implemented in hardware, firmware, software, or any combination of hardware, firmware, and/or software. When implemented in hardware, some or all of the blocks, operations, techniques, etc. can be implemented in, for example, a custom integrated circuit (IC), an application specific integrated circuit (ASIC), a field programmable logic array (FPGA), a programmable logic array (PLA), etc.

Results from such genotyping can be stored in a data storage unit, such as a data carrier, including computer databases, data storage disks, or by other convenient data storage means. In certain embodiments, the computer database is an object database, a relational database or a post-relational database. Data can be retrieved from the data storage unit using any convenient data query method.

When implemented in software, the software can be stored in any known computer readable medium such as on a magnetic disk, an optical disk, or other storage medium, in a RAM or ROM or flash memory of a computer, processor, hard disk drive, optical disk drive, tape drive, etc. Likewise, the software can be delivered to a user or a computing system via any known delivery method including, for example, on a computer readable disk or other transportable computer storage mechanism.

The steps of the claimed methods can be operational with numerous other general purpose or special purpose computing system environments or configurations. Examples of well known computing systems, environments, and/or configurations that can be suitable for use with the methods or system of the claims include, but are not limited to, personal computers, server computers, hand-held or laptop devices, multiprocessor systems, microprocessor-based systems, set top boxes, programmable consumer electronics, network PCs, minicomputers, mainframe computers, distributed computing environments that include any of the above systems or devices, and the like.

The steps of the claimed method and system can be described in the general context of computer-executable instructions, such as program modules, being executed by a computer. Generally, program modules include routines, programs, objects, components, and/or data structures that perform particular tasks or implement particular abstract data types. The methods and apparatus can also be practiced in distributed computing environments where tasks are performed by remote processing devices that are linked through a communications network. In both integrated and distributed computing environments, program modules can be located in both local and remote computer storage media including memory storage devices. Numerous alternative embodiments could be implemented, using either current technology or technology developed after the filing date of this application, which would still fall within the scope of the claims defining the disclosure.

While the risk evaluation system and method, and other elements, have been described as preferably being implemented in software, they can be implemented in hardware, firmware, etc., and can be implemented by any other processor. Thus, the elements described herein can be implemented in a standard multi-purpose CPU or on specifically designed hardware or firmware such as an application-specific integrated circuit (ASIC) or other hard-wired device as desired. When implemented in software, the software routine can be stored in any computer readable memory such as on a magnetic disk, a laser disk, or other storage medium, in a RAM or ROM of a computer or processor, in any database, etc. Likewise, this software can be delivered to a user or a screening system via any known or desired delivery method including, for example, on a computer readable disk or other transportable computer storage mechanism or over a communication channel, for example, a telephone line, the internet, or wireless communication. Modifications and variations can be made in the techniques and structures described and illustrated herein without departing from the spirit and scope of the present disclosure.

ASD Therapeutics

Resarch into a cure for Pervasive Developmental Disorders (PDD), such as Autism Spectrum Disorder (ASD) or Pervasive Developmental Disorders—Not Otherwise Specified (PDD-NOS), such as Asperger Syndrome, Rett Syndrome, Fragile X Syndrome, and/or Childhood Disintegrative Disorder is ongoing. Ways to help minimize the symptoms of autism and to maximize learning exist, including but not limited to, behavioral therapy, educational and/or school-based options, and medication options, although currently there are no medications that can cure autism spectrum disorders or all of the symptoms. The U.S. Food and Drug Administration has not yet approved any medications specifically for the treatment of autism, but in many cases medication can treat some of the symptoms associated with autism. These treatments can include behavior management therapy to help reinforce wanted behaviors and reduce unwanted behaviors, which is often based on Applied Behavior Analysis (ABA), use of speech-language therapists to help people with autism improve their ability to communicate and interact with others, use of occupational therapists to help people find ways to adjust tasks to match their needs and abilities, and physical therapists design activities and exercise to build motor control and improve posture and balance, free appropriate public education from age 3 through high school or age 21, integration of a team of people, including the parents, teachers, caregivers, school psychologists, and other child development specialists to work together to design an Individualized Education Plan (IEP) to help guide the child's school experiences, selective serotonin reuptake inhibitors (SSRIs), tricyclics, psychoactive/anti-psychotics, stimulants, and anti-anxiety drugs are among the medications that a health care provider might use to treat symptoms of autism spectrum disorders.

A person skilled in the art will appreciate and understand that the genetic variants described herein in general may not, by themselves, provide an absolute identification of individuals who can develop a developmental disorder or related conditions. The variants described herein can indicate increased and/or decreased likelihood that individuals carrying the at-risk or protective variants of the disclosure can develop symptoms associated with a developmental disorder. This information can be used to, for example, initiate preventive measures at an early stage, perform regular physical and/or mental exams to monitor the progress and/or appearance of symptoms, or to schedule exams at a regular interval to identify early symptoms, so as to be able to apply treatment at an early stage. This is in particular important since developmental disorders and related disorders are heterogeneous disorders with symptoms that can be individually vague. Screening criteria can comprise a number of symptoms to be present over a period of time; therefore, it is important to be able to establish additional risk factors that can aid in the screening, or facilitate the screening through in-depth phenotyping and/or more frequent examination, or both. For example, individuals with early symptoms that typically are not individually associated with a clinical screening of a developmental disorder and carry an at-risk genetic variation can benefit from early therapeutic treatment, or other preventive measure, or more rigorous supervision or more frequent examination. Likewise, individuals that have a family history of the disease, or are carriers of other risk factors associated with a developmental disorder can, in the context of additionally carrying at least one at-risk genetic variation, benefit from early therapy or other treatment.

Early symptoms of behavioral disorders such as a developmental disorder and related conditions may not be sufficient to fulfill standardized screening criteria. To fulfill those, a certain pattern of symptoms and behavioral disturbance needs to manifest itself over a period of time. Sometimes, certain physical characteristics can also be present. This makes at-risk genetic variants valuable in a screening setting, in particular high-risk variants. Determination of the presence of such variants warrants increased monitoring of the individual in question. Appearance of symptoms combined with the presence of such variants facilitates early screening, which makes early treatment possible. Genetic testing can thus be used to aid in the screening of disease in its early stages, before all criteria for formal screening criteria are all fulfilled. It is well established that early treatment is extremely important for developmental disorders and related disorders, which lends further support to the value of genetic testing for early diagnosis, prognosis, or theranosis of these disorders.

The present disclosure provides methods for identifying compounds or agents that can be used to treat a developmental disorder. Thus, the genetic variations and associated polypeptides of the disclosure are useful as targets for the identification and/or development of therapeutic agents. In certain embodiments, such methods include assaying the ability of an agent or compound to modulate the activity and/or expression of a nucleic acid that is associated with at least one genetic variation described herein, encoded products of the gene sequence, and any other molecules or polypeptides associated with these genes. This in turn can be used to identify agents or compounds that inhibit, enhance, or alter the undesired activity, localization, binding and/or expression of the encoded nucleic acid product, such as mRNA or polypeptides. For example, in some embodiments, small molecule drugs can be developed to target the aberrant polypeptide(s) or RNA(s) resulting from specific disease-causing mutation(s) within a gene, such as described in: Peltz et al. (2009) RNA Biology 6(3):329-34; Van Goor et al. (2009) Proc. Natl. Acad. Sci. USA 106(44):18825-30; Van Goor et al. (2011) Proc. Natl. Acad. Sci. USA 108(46): 18843-8; Ramsey et al. (2011) N. Engl. J. Med. 365(18): 1663-72. The polypeptides associated with the CNVs listed in Table 1 are described in Table 4 as the accession number (accession) of mRNAs that would encode said polypeptides. Assays for performing such experiments can be performed in cell-based systems or in cell-free systems, as known to the skilled person. Cell-based systems include cells naturally expressing the nucleic acids of interest, or recombinant cells that have been genetically modified so as to express a certain desired nucleic acid molecule.

Variant gene expression in a subject can be assessed by expression of a variant-containing nucleic acid sequence or by altered expression of a normal/wild-type nucleic acid sequence due to variants affecting the level or pattern of expression of the normal transcripts, for example, variants in the regulatory or control region of the gene. Assays for gene expression include direct nucleic acid assays (mRNA), assays for expressed polypeptide levels, or assays of collateral compounds involved in a pathway, for example, a signal pathway. Furthermore, the expression of genes that are up- or down-regulated in response to the signal pathway can also be assayed. One embodiment includes operably linking a reporter gene, such as luciferase, to the regulatory region of one or more gene of interest.

Modulators of gene expression can in some embodiments be identified when a cell is contacted with a candidate compound or agent, and the expression of mRNA is determined. The expression level of mRNA in the presence of the candidate compound or agent is compared to the expression level in the absence of the compound or agent. Based on this comparison, candidate compounds or agents for treating a developmental disorder can be identified as those modulating the gene expression of the variant gene, or gene expression of one or more other genes occurring within the same biological pathway or known, for example, to be binding partners of the variant gene. When expression of mRNA or the encoded polypeptide is statistically significantly greater in the presence of the candidate compound or agent than in its absence, then the candidate compound or agent is identified as a stimulator or up-regulator of expression of the nucleic acid. When nucleic acid expression or polypeptide level is statistically significantly less in the presence of the candidate compound or agent than in its absence, then the candidate compound can be identified as an inhibitor or down-regulator of the nucleic acid expression. The disclosure further provides methods of treatment using a compound identified through drug (compound and/or agent) screening as a gene modulator.

The genetic variations described herein can be used to identify novel therapeutic targets for a developmental disorder. For example, genes containing, or in linkage disequilibrium with, the genetic variations, or their products, as well as genes or their products that are directly or indirectly regulated by or interact with these variant genes or their products, can be targeted for the development of therapeutic agents to treat a developmental disorder, or prevent or delay onset of symptoms associated with a developmental disorder. Therapeutic agents can comprise one or more of, for example, small non-polypeptide and non-nucleic acids, polypeptides, peptides, polypeptide fragments, nucleic acids (RNA, DNA, RNAJ, PNA (peptide nucleic acids), or their derivatives or mimetics which can modulate the function and/or levels of the target genes or their gene products. In some embodiments, treatment of ASD can comprise treatment of one of the genes, or gene products derived thereof, such as mRNA or a polypeptide, with one or more of the therapeutics disclosed herein. In some embodiments, treatment of ASD can comprise treatment of 2 or 3, or 4, or 5, or 6, or 7, or 8, or 9, or 10 or more of the genes, or gene products derived there from, with 2 or 3, or 4, or 5, or 6, or 7, or 8, or 9, or 10 or more of the therapeutics disclosed herein.

RNA Therapeutics

The nucleic acids and/or variants of the disclosure, or nucleic acids comprising their complementary sequence, can be used as antisense constructs to control gene expression in cells, tissues or organs. The methodology associated with antisense techniques is well known to the skilled artisan, and is described and reviewed in Antisense Drug Technology: Principles, Strategies, and Applications, Crooke, Marcel Dekker Inc., New York (2001) In general, antisense nucleic acids are designed to be complementary to a region of mRNA expressed by a gene, so that the antisense molecule hybridizes to the mRNA, thus blocking translation of the mRNA into a polypeptide Several classes of antisense oligonucleotide are known to those skilled in the art, including cleavers and blockers. The former bind to target RNA sites, activate intracellular nucleases {e.g., Rnase H or Rnase L) that cleave the target RNA. Blockers bind to target RNA, inhibit polypeptide translation by steric hindrance of the ribosomes. Examples of blockers include nucleic acids, morpholino compounds, locked nucleic acids and methylphosphonates (Thompson, Drug Discovery Today, 7:912-917 (2002)) Antisense oligonucleotides are useful directly as therapeutic agents, and are also useful for determining and validating gene function, for example, by gene knock-out or gene knock-down experiments. Antisense technology is further described in Lavery et al., Curr. Opin. Drug Discov Devel 6 561-569 (2003), Stephens et al., Curr. Opin. Mol Ther. 5.118-122 (2003), Kurreck, Eur. J. Biochem. 270.1628-44 (2003), Dias et al, Mol Cancer Ter. 1-347-55 (2002), Chen, Methods Mol Med. 75:621-636 (2003), Wang et al., Curr Cancer Drug Targets 1.177-96 (2001), and Bennett, Antisense Nucleic Acid Drug. Dev. 12 215-24 (2002)

The variants described herein can be used for the selection and design of antisense reagents that are specific for particular variants (e.g., particular genetic variations, or polymorphic markers in LD with particular genetic variations). Using information about the variants described herein, antisense oligonucleotides or other antisense molecules that specifically target mRNA molecules that contain one or more variants of the disclosure can be designed. In this manner, expression of mRNA molecules that contain one or more variant of the present disclosure (markers and/or haplotypes) can be inhibited or blocked In some embodiments, the antisense molecules are designed to specifically bind a particular allelic form (i.e., one or several variants (alleles and/or haplotypes)) of the target nucleic acid, thereby inhibiting translation of a product originating from this specific allele or haplotype, but which do not bind other or alternate variants at the specific polymorphic sites of the target nucleic acid molecule.

As antisense molecules can be used to inactivate mRNA so as to inhibit gene expression, and thus polypeptide expression, the molecules can be used to treat a disease or disorder, such as a developmental disorder. The methodology can involve cleavage by means of ribozymes containing nucleotide sequences complementary to one or more regions in the mRNA that attenuate the ability of the mRNA to be translated Such mRNA regions include, for example, polypeptide-coding regions, in particular polypeptide-coding regions corresponding to catalytic activity, substrate and/or ligand binding sites, or other functional domains of a polypeptide.

The phenomenon of RNA interference (RNAi) has been actively studied for the last decade, since its original discovery in C. elegans (Fire et al., Nature 391:806-11 (1998)), and in recent years its potential use in treatment of human disease has been actively pursued (reviewed in Kim & Rossi, Nature Rev, Genet. 8: 173-204 (2007)). RNA interference (RNAi), also called gene silencing, is based on using double-stranded RNA molecules (dsRNA) to turn off specific genes. In the cell, cytoplasmic double-stranded RNA molecules (dsRNA) are processed by cellular complexes into small interfering RNA (siRNA). The siRNA guide the targeting of a polypeptide-RNA complex to specific sites on a target mRNA, leading to cleavage of the mRNA (Thompson, Drug Discovery Today, 7:912-917 (2002)). The siRNA molecules are typically about 20, 21, 22 or 23 nucleotides in length. Thus, one aspect of the disclosure relates to isolated nucleic acid sequences, and the use of those molecules for RNA interference, for example, as small interfering RNA molecules (siRNA). In some embodiments, the isolated nucleic acid sequences can be 18-26 nucleotides in length, preferably 19-25 nucleotides in length, more preferably 20-24 nucleotides in length, and more preferably 21, 22 or 23 nucleotides in length.

Another pathway for RNAi-mediated gene silencing originates in endogenously encoded primary microRNA (pn-miRNA) transcripts, which are processed in the cell to generate precursor miRNA (pre-miRNA). These miRNA molecules are exported from the nucleus to the cytoplasm, where they undergo processing to generate mature miRNA molecules (miRNA), which direct translational inhibition by recognizing target sites in the 3' untranslated regions of mRNAs, and subsequent mRNA degradation by processing P-bodies (reviewed in Kim & Rossi, Nature Rev. Genet. 8: 173-204 (2007)).

Clinical applications of RNAi include the incorporation of synthetic siRNA duplexes, which preferably are approximately 20-23 nucleotides in size, and preferably have 3' overlaps of 2 nucleotides. Knockdown of gene expression is established by sequence-specific design for the target mRNA. Several commercial sites for optimal design and synthesis of such molecules are known to those skilled in the art.

Other applications provide longer siRNA molecules (typically 25-30 nucleotides in length, preferably about 27 nucleotides), as well as small hairpin RNAs (shRNAs; typically about 29 nucleotides in length). The latter are naturally expressed, as described in Amarzguioui et al. (FEBS Lett. 579:5974-81 (2005)). Chemically synthetic siRNAs and shRNAs are substrates for in vivo processing, and in some cases provide more potent gene-silencing than shorter designs (Kim et al., Nature Biotechnol. 23:222-226 (2005); Siola et al., Nature Biotechnol. 23:227-231 (2005)). In general siRNAs provide for transient silencing of gene expression, because their intracellular concentration is diluted by subsequent cell divisions. By contrast, expressed shRNAs mediate long-term, stable knockdown of target transcripts, for as long as transcription of the shRNA takes place (Marques et al., Nature Biotechnol. 23.559-565 (2006), Brummelkamp et al., Science 296. 550-553 (2002)).

Since RNAi molecules, including siRNA, miRNA and shRNA, act in a sequence-dependent manner, variants described herein can be used to design RNAi reagents that recognize specific nucleic acids comprising specific genetic variations, alleles and/or haplotypes, while not recognizing nucleic acid sequences not comprising the genetic variation, or comprising other alleles or haplotypes. These RNAi reagents can thus recognize and destroy the target nucleic acid sequences. As with antisense reagents, RNAi reagents can be useful as therapeutic agents (i.e., for turning off disease-associated genes or disease-associated gene variants), but can also be useful for characterizing and validating gene function (e.g., by gene knock-out or gene knock-down experiments).

Delivery of RNAi can be performed by a range of methodologies known to those skilled in the art. Methods utilizing non-viral delivery include cholesterol, stable nucleic acid-lipid particle (SNALP), heavy-chain antibody fragment (Fab), aptamers and nanoparticles Viral delivery methods include use of lentivirus, adenovirus and adeno-associated virus. The siRNA molecules are in some embodiments chemically modified to increase their stability. This can include modifications at the 2' position of the ribose, including 2'-O-methylpunnes and 2'-fluoropyrimidmes, which provide resistance to RNase activity. Other chemical modifications are possible and known to those skilled in the art.

The following references provide a further summary of RNAi, and possibilities for targeting specific genes using RNAi: Kim & Rossi, Nat. Rev. Genet. 8: 173-184 (2007), Chen & Rajewsky, Nat. Rev. Genet. 8: 93-103 (2007), Reynolds, et al., Nat. Biotechnol 22 326-330 (2004), Chi et al., Proc. Natl. Acad. Sa. USA 100-6343-6346 (2003), Vickers et al., J Biol Chem. 278:7108-7118 (2003), Agami, Curr Opin. Chem. Biol. 6:829-834 (2002), Lavery, et al., Curr. Opin. Drug Discov. Devel. 6:561-569 (2003), Shi, Trends Genet. 19:9-12 (2003), Shuey et al., Drug Discov. Today 7 1040-46 (2002), McManus et al., Nat. Rev. Genet. 3.737-747 (2002), Xia et al., Nat. Biotechnol. 20.1006-10 (2002), Plasterk et al., Curr. Opin Genet. Dev. 10 562-7 (2000), Bosher et al., Nat. Cell Biol. 2:E31-6 (2000), and Hunter, Curr. Biol. 9:R440-442 (1999).

A genetic defect leading to increased predisposition or risk for development of a disease, including a developmental disorder, or a defect causing the disease, can be corrected permanently by administering to a subject carrying the defect a nucleic acid fragment that incorporates a repair sequence that supplies the normal/wild-type nucleotide(s) at the site of the genetic defect. Such site-specific repair sequence can encompass an RNA/DNA oligonucleotide that operates to promote endogenous repair of a subject's genomic DNA. The administration of the repair sequence can be performed by an appropriate vehicle, such as a complex with polyethelamine, encapsulated in anionic liposomes, a viral vector such as an adenovirus vector, or other pharmaceutical compositions suitable for promoting intracellular uptake of the administered nucleic acid The genetic defect can then be overcome, since the chimeric oligonucleotides induce the incorporation of the normal sequence into the genome of the subject, leading to expression of the normal/wild-type gene product. The replacement is propagated, thus rendering a permanent repair and alleviation of the symptoms associated with the disease or condition.

Double stranded oligonucleotides are formed by the assembly of two distinct oligonucleotide sequences where the oligonucleotide sequence of one strand is complementary to the oligonucleotide sequence of the second strand; such double stranded oligonucleotides are generally assembled from two separate oligonucleotides (e.g., siRNA), or from a single molecule that folds on itself to form a double stranded structure (e.g., shRNA or short hairpin RNA). These double stranded oligonucleotides known in the art all have a common feature in that each strand of the duplex has a distinct nucleotide sequence, wherein only one nucleotide sequence region (guide sequence or the antisense sequence) has complementarity to a target nucleic acid sequence and the other strand (sense sequence) comprises nucleotide sequence that is homologous to the target nucleic acid sequence.

Double stranded RNA induced gene silencing can occur on at least three different levels: (i) transcription inactivation, which refers to RNA guided DNA or histone methylation; (ii) siRNA induced mRNA degradation; and (iii) mRNA induced transcriptional attenuation. It is generally considered that the major mechanism of RNA induced silencing (RNA interference, or RNAi) in mammalian cells is mRNA degradation. RNA interference (RNAi) is a mechanism that inhibits gene expression at the stage of translation or by hindering the transcription of specific genes. Specific RNAi pathway polypeptides are guided by the dsRNA to the targeted messenger RNA (mRNA), where they "cleave" the target, breaking it down into smaller portions that can no longer be translated into a polypeptide. Initial attempts to use RNAi in mammalian cells focused on the use of long strands of dsRNA. However, these attempts to induce RNAi met with limited success, due in part to the induction of the interferon response, which results in a general, as opposed to a target-specific, inhibition of polypeptide synthesis. Thus, long dsRNA is not a viable option for RNAi in mammalian systems. Another outcome is epigenetic changes to a gene—histone modification and DNA methylation—affecting the degree the gene is transcribed.

More recently it has been shown that when short (18-30 bp) RNA duplexes are introduced into mammalian cells in culture, sequence-specific inhibition of target mRNA can be realized without inducing an interferon response. Certain of these short dsRNAs, referred to as small inhibitory RNAs ("siRNAs"), can act catalytically at sub-molar concentrations to cleave greater than 95% of the target mRNA in the cell. A description of the mechanisms for siRNA activity, as well as some of its applications are described in Provost et al., Ribonuclease Activity and RNA Binding of Recombinant Human Dicer, E.M.B.O. J., 2002 Nov. 1; 21(21): 5864-5874; Tabara et al., The dsRNA Binding Protein RDE-4 Interacts with RDE-1, DCR-1 and a DexH-box Helicase to Direct RNAi in C. elegans, Cell 2002, Jun. 28; 109(7):861-71; Ketting et al., Dicer Functions in RNA Interference and in Synthesis of Small RNA Involved in Developmental Timing in C. elegans; Martinez et al., Single-Stranded Antisense siRNAs Guide Target RNA Cleavage in RNAi, Cell 2002, September. 6; 110(5):563; Hutvagner & Zamore, A microRNA in a multiple-turnover RNAi enzyme complex, Science 2002, 297:2056.

From a mechanistic perspective, introduction of long double stranded RNA into plants and invertebrate cells is broken down into siRNA by a Type III endonuclease known as Dicer. Sharp, RNA interference—2001, Genes Dev. 2001, 15:485. Dicer, a ribonuclease-III-like enzyme, processes the dsRNA into 19-23 base pair short interfering RNAs with characteristic two base 3' overhangs. Bernstein, Caudy, Hammond, & Hannon, Role for a bidentate ribonuclease in the initiation step of RNA interference, Nature 2001, 409: 363. The siRNAs are then incorporated into an RNA-induced silencing complex (RISC) where one or more helicases unwind the siRNA duplex, enabling the complementary antisense strand to guide target recognition (Nykanen, Haley, & Zamore, ATP requirements and small interfering RNA structure in the RNA interference pathway, Cell 2001, 107:309). Upon binding to the appropriate target mRNA, one or more endonucleases within the RISC cleaves the target to induce silencing. Elbashir, Lendeckel, & Tuschl, RNA interference is mediated by 21- and 22-nucleotide RNAs, Genes Dev 2001, 15:188, FIG. 1.

Generally, the antisense sequence is retained in the active RISC complex and guides the RISC to the target nucleotide sequence by means of complementary base-pairing of the antisense sequence with the target sequence for mediating sequence-specific RNA interference. It is known in the art that in some cell culture systems, certain types of unmodified siRNAs can exhibit "off target" effects. It is hypothesized that this off-target effect involves the participation of the sense sequence instead of the antisense sequence of the siRNA in the RISC complex (see for example, Schwarz et al., 2003, Cell, 115, 199-208). In this instance the sense sequence is believed to direct the RISC complex to a sequence (off-target sequence) that is distinct from the intended target sequence, resulting in the inhibition of the off-target sequence. In these double stranded nucleic acid sequences, each strand is complementary to a distinct target nucleic acid sequence. However, the off-targets that are affected by these dsRNAs are not entirely predictable and are non-specific.

The term "siRNA" refers to small inhibitory RNA duplexes that induce the RNA interference (RNAi) pathway. These molecules can vary in length (generally between 18-30 basepairs) and contain varying degrees of complementarity to their target mRNA in the antisense strand. Some, but not all, siRNA have unpaired overhanging bases on the 5' or 3' end of the sense strand and/or the antisense strand. The term "siRNA" includes duplexes of two separate strands, as well as single strands that can form hairpin structures comprising a duplex region. Small interfering RNA (siRNA), sometimes known as short interfering RNA or silencing RNA, are a class of 20-25 nucleotide-long double-stranded RNA molecules that play a variety of roles in biology.

While the two RNA strands do not need to be completely complementary, the strands should be sufficiently complementary to hybridize to form a duplex structure. In some instances, the complementary RNA strand can be less than 30 nucleotides, preferably less than 25 nucleotides in length, more preferably 19 to 24 nucleotides in length, more preferably 20-23 nucleotides in length, and even more preferably 22 nucleotides in length. The dsRNA of the present disclosure can further comprise at least one single-stranded nucleotide overhang. The dsRNA of the present disclosure can further comprise a substituted or chemically modified nucleotide. As discussed in detail below, the dsRNA can be synthesized by standard methods known in the art.

siRNA can be divided into five (5) groups including non-functional, semi-functional, functional, highly functional, and hyper-functional based on the level or degree of silencing that they induce in cultured cell lines. As used herein, these definitions are based on a set of conditions where the siRNA is transfected into the cell line at a concentration of 100 nM and the level of silencing is tested at a time of roughly 24 hours after transfection, and not exceeding 72 hours after transfection. In this context, "non-functional siRNA" are defined as those siRNA that induce less than 50% (<50%) target silencing. "Semi-functional siRNA" induce 50-79% target silencing. "Functional siRNA" are molecules that induce 80-95% gene silencing. "Highly-functional siRNA" are molecules that induce greater than 95% gene silencing. "Hyperfunctional siRNA" are a special class of molecules. For purposes of this document, hyperfunctional siRNA are defined as those molecules that: (1) induce greater than 95% silencing of a specific target when they are transfected at subnanomolar concentrations (i.e., less than one nanomolar); and/or (2) induce functional (or better) levels of silencing for greater than 96 hours. These relative functionalities (though not intended to be absolutes) can be used to compare siRNAs to a particular target for applications such as functional genomics, target identification and therapeutics.

microRNAs (miRNA) are single-stranded RNA molecules of about 21-23 nucleotides in length, which regulate gene expression. miRNAs are encoded by genes that are transcribed from DNA but not translated into a polypeptide (non-coding RNA); instead they are processed from primary transcripts known as pri-miRNA to short stem-loop structures called pre-miRNA and finally to functional miRNA. Mature miRNA molecules are partially complementary to one or more messenger RNA (mRNA) molecules, and their main function is to downregulate gene expression.

Antibody-Based Therapeutics

The present disclosure embodies agents that modulate a peptide sequence or RNA expressed from a gene associated with a developmental disorder. The term "biomarker", as used herein, can comprise a genetic variation of the present disclosure or a gene product, for example, RNA and polypeptides, of any one of the genes listed in Tables 1-4. Such modulating agents include, but are not limited to, polypeptides, peptidomimetics, peptoids, or any other forms of a molecule, which bind to, and alter the signaling or function associated with the a developmental disorder associated biomarker, have an inhibitory or stimulatory effect on the developmental disorder associated biomarkers, or have a stimulatory or inhibitory effect on the expression or activity of the a developmental disorder associated biomarkers' ligands, for example, polyclonal antibodies and/or monoclonal antibodies that specifically bind one form of the gene product but not to the other form of the gene product are also provided, or which bind a portion of either the variant or the reference gene product that contains the polymorphic site or sites.

In some embodiments, the present disclosure provides antibody-based agents targeting a developmental disorder associated biomarkers. The antibody-based agents in any suitable form of an antibody e.g., monoclonal, polyclonal, or synthetic, can be utilized in the therapeutic methods disclosed herein. The antibody-based agents include any target-binding fragment of an antibody and also peptibodies, which are engineered therapeutic molecules that can bind to human drug targets and contain peptides linked to the constant domains of antibodies. In some embodiments, the antibodies used for targeting a developmental disorder associated biomarkers are humanized antibodies. Methods for humanizing antibodies are well known in the art. In some embodiments, the therapeutic antibodies comprise an antibody generated against a developmental disorder associated biomarkers described in the present disclosure, wherein the antibodies are conjugated to another agent or agents, for example, a cytotoxic agent or agents.

The term "antibody" as used herein refers to immunoglobulin molecules and immunologically active portions of immunoglobulin molecules, i.e., molecules that contain antigen-binding sites that specifically bind an antigen. A molecule that specifically binds to a polypeptide of the disclosure is a molecule that binds to that polypeptide or a fragment thereof, but does not substantially bind other molecules in a nucleic acid sample, which naturally contains the polypeptide. Examples of immunologically active portions of immunoglobulin molecules include F(ab) and F(ab')2 fragments which can be generated by treating the antibody with an enzyme such as pepsin. The disclosure provides polyclonal and monoclonal antibodies that bind to a polypeptide of the disclosure. The term "monoclonal antibody" or "monoclonal antibody composition", as used herein, refers to a population of antibody molecules that contain only one species of an antigen binding site capable of immunoreacting with a particular epitope of a polypeptide of the disclosure. A monoclonal antibody composition thus typically displays a single binding affinity for a particular polypeptide of the disclosure with which it immunoreacts.

Polyclonal antibodies can be prepared as described above by immunizing a suitable subject with a desired immunogen, e.g., polypeptide of the disclosure or a fragment thereof. The antibody titer in the immunized subject can be monitored over time by standard techniques, such as with an enzyme linked immunosorbent assay (ELISA) using immobilized polypeptide. If desired, the antibody molecules directed against the polypeptide can be isolated from the mammal (e.g., from the blood) and further purified by well-known techniques, such as protein A chromatography to obtain the IgG fraction. At an appropriate time after immunization, e.g., when the antibody titers are highest, antibody-producing cells can be obtained from the subject and used to prepare monoclonal antibodies by standard techniques, such as the hybridoma technique originally described by Kohler and Milstein, Nature 256:495-497 (1975), the human B cell hybridoma technique (Kozbor et al., Immunol Today 4: 72 (1983)), the EBV-hybridoma technique (Cole et al., Monoclonal Antibodies and Cancer Therapy, Alan R. Liss (1985) Inc., pp. 77-96) or trioma techniques. The technology for producing hybridomas is well known (see generally Current Protocols in Immunology (1994) Coligan et al., (eds.) John Wiley & Sons, Inc., New York, N.Y.). Briefly, an immortal cell line (typically a myeloma) is fused to lymphocytes (typically splenocytes) from a mammal immunized with an immunogen as described above, and the culture supernatants of the resulting hybridoma cells are screened to identify a hybridoma producing a monoclonal antibody that binds a polypeptide of the disclosure.

Any of the many well known protocols used for fusing lymphocytes and immortalized cell lines can be applied for the purpose of generating a monoclonal antibody to a polypeptide of the disclosure (see, e.g., Current Protocols in Immunology, supra; Galfre et al., Nature 266:55052 (1977); R. H. Kenneth, in Monoclonal Antibodies: A New Dimension In Biological Analyses, Plenum Publishing Corp., New York, N.Y. (1980); and Lerner, Yale J. Biol. Med. 54:387-402 (1981)). Moreover, the ordinarily skilled worker can appreciate that there are many variations of such methods that also would be useful. Alternative to preparing monoclonal antibody-secreting hybridomas, a monoclonal antibody to a polypeptide of the disclosure can be identified and isolated by screening a recombinant combinatorial immunoglobulin library (e.g., an antibody phage display library) with the polypeptide to thereby isolate immunoglobulin library members that bind the polypeptide. Kits for generating and screening phage display libraries are commercially available (e.g., the Pharmacia Recombinant Phage Antibody System, Catalog No. 27-9400-01; and the Stratagene SurfZAP$^\alpha$ Phage Display Kit, Catalog No. 240612). Additionally, examples of methods and reagents particularly amenable for use in generating and screening antibody display library can be found in, for example, U.S. Pat. No. 5,223,409; PCT Publication Nos. WO 92/18619, WO 91/17271, WO 92/20791, WO 92/15679; WO 93/01288, WO 92/01047, WO 92/09690, and WO 90/02809; Fuchs et al., Bio/Technology 9: 1370-1372 (1991); Hay et al., Hum. Antibod. Hybridomas 3:81-85 (1992); Huse et al., Science 246: 1275-1281 (1989); and Griffiths et al., EMBO J. 12:725-734 (1993).

Additionally, recombinant antibodies, such as chimeric and humanized monoclonal antibodies, comprising both human and non-human portions, which can be made using standard recombinant DNA techniques, are within the scope of the disclosure. Such chimeric and humanized monoclonal antibodies can be produced by recombinant DNA techniques known in the art.

In general, antibodies of the disclosure (e.g., a monoclonal antibody) can be used to isolate a polypeptide of the disclosure by standard techniques, such as affinity chromatography or immunoprecipitation. A polypeptide-specific antibody can facilitate the purification of natural polypeptide from cells and of recombinants produced polypeptide expressed in host cells Moreover, an antibody specific for a polypeptide of the disclosure can be used to detect the polypeptide (e.g., in a cellular lysate, cell supernatant, or tissue sample) in order to evaluate the abundance and pattern of expression of the polypeptide. Antibodies can be used diagnostically, prognostically, or theranostically to monitor polypeptide levels in tissue as part of a clinical testing procedure, e.g., to, for example, determine the efficacy of a given treatment regimen. The antibody can be coupled to a detectable substance to facilitate its detection. Examples of detectable substances include various enzymes, prosthetic groups, fluorescent materials, luminescent materials, bioluminescent materials, and radioactive materials. Examples of suitable enzymes include horseradish peroxidase, alkaline phosphatase, beta-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotnazinylamine fluorescein, dansyl chloride or phycoerythnn; an example of a luminescent material includes luminol; examples of bioluminescent materials include luciferase, luciferin, and aequorin, and examples of suitable radioactive material include $^{125}I$, $^{131}I$, $^{35}S$ or $^{3}H$. Antibodies can also be useful in pharmacogenomic analysis. In such embodiments, antibodies against variant polypeptides encoded by nucleic acids according to the disclosure, such as variant polypeptides that are encoded by nucleic acids that contain at least one genetic variation of the disclosure, can be used to identify individuals that can benefit from modified treatment modalities.

Antibodies can furthermore be useful for assessing expression of variant polypeptides in disease states, such as in active stages of a disease, or in an individual with a predisposition to a disease related to the function of the polypeptide, in particular a developmental disorder. Antibodies specific for a variant polypeptide of the present disclosure that is encoded by a nucleic acid that comprises at least one polymorphic marker or haplotype as described herein can be used to screen for the presence of the variant polypeptide, for example, to screen for a predisposition to a developmental disorder as indicated by the presence of the variant polypeptide.

Antibodies can be used in other methods. Thus, antibodies are useful as screening tools for evaluating polypeptides, such as variant polypeptides of the disclosure, in conjunction with analysis by electrophoretic mobility, isoelectric point, tryptic or other protease digest, or for use in other physical assays known to those skilled in the art. Antibodies can also be used in tissue typing. In one such embodiment, a specific variant polypeptide has been correlated with expression in a specific tissue type, and antibodies specific for the variant polypeptide can then be used to identify the specific tissue type.

Subcellular localization of polypeptides, including variant polypeptides, can also be determined using antibodies, and can be applied to assess aberrant subcellular localization of the polypeptide in cells in various tissues. Such use can be applied in genetic testing, but also in monitoring a particular treatment modality. In the case where treatment is aimed at correcting the expression level or presence of the variant polypeptide or aberrant tissue distribution or developmental expression of the variant polypeptide, antibodies specific for the variant polypeptide or fragments thereof can be used to monitor therapeutic efficacy.

Antibodies are further useful for inhibiting variant polypeptide function, for example, by blocking the binding of a variant polypeptide to a binding molecule or partner. Such uses can also be applied in a therapeutic context in which treatment involves inhibiting a variant polypeptide's function. An antibody can be for example, be used to block or competitively inhibit binding, thereby modulating (i.e., agonizing or antagonizing) the activity of the polypeptide. Antibodies can be prepared against specific polypeptide fragments containing sites for specific function or against an intact polypeptide that is associated with a cell or cell membrane.

The present disclosure also embodies the use of any pharmacologic agent that can be conjugated to an antibody or an antibody binding fragment, and delivered in active form. Examples of such agents include cytotoxins, radioisotopes, hormones such as a steroid, anti-metabolites such as cytosines, and chemotherapeutic agents. Other embodiments can include agents such as a coagulant, a cytokine, growth factor, bacterial endotoxin or a moiety of bacterial endotoxin. The targeting antibody-based agent directs the toxin to, and thereby selectively modulates the cell expressing the targeted surface receptor. In some embodiments, therapeutic antibodies employ cross-linkers that provide high in vivo stability (Thorpe et al., Cancer Res., 48:6396, 1988). In any event, it is proposed that agents such as these can, if desired, be successfully conjugated to antibodies or antibody binding fragments, in a manner that can allow their targeting, internalization, release or presentation at the site of the targeted cells expressing the ASD associated biomarkers using known conjugation technology. For administration in vivo, for example, an antibody can be linked with an additional therapeutic payload, such as radionuclide, an enzyme, an immunogenic epitope, or a cytotoxic agent, including bacterial toxins (diphtheria or plant toxins, such as ricin). The in vivo half-life of an antibody or a fragment thereof can be increased by pegylation through conjugation to polyethylene glycol.

Gene Therapy

In some embodiments, gene therapy can be used as a therapeutic to modulate a peptide sequence or RNA expressed from a gene associated with a developmental disorder. Gene therapy involves the use of DNA as a pharmaceutical agent to treat disease. DNA can be used to supplement or alter genes within an individual's cells as a therapy to treat disease. Gene therapy can be used to alter the signaling or function associated with the a developmental disorder associated biomarker, have an inhibitory or stimulatory effect on the developmental disorder associated biomarkers, or have a stimulatory or inhibitory effect on the expression or activity of the a developmental disorder associated biomarkers' ligands. In one embodiment, gene therapy involves using DNA that encodes a functional, therapeutic gene in order to replace a mutated gene. Other forms involve directly correcting a mutation, or using DNA that encodes a therapeutic polypeptide drug (rather than a natural human gene) to provide treatment. DNA that encodes a therapeutic polypeptide can be packaged within a vector, which can used to introduce the DNA inside cells within the body. Once inside, the DNA becomes expressed by the cell machinery, resulting in the production of the therapeutic, which in turn can treat the subject's disease.

Gene therapy agents and other agents for testing therapeutics can include plasmids, viral vectors, artificial chromosomes and the like containing therapeutic genes or polynucleotides encoding therapeutic products, including coding sequences for small interfering RNA (siRNA), ribozymes and antisense RNA, which in certain further embodiments can comprise an operably linked promoter such as a constitutive promoter or a regulatable promoter, such as an inducible promoter (e.g., IPTG inducible), a tightly regulated promoter (e.g., a promoter that permits little or no detectable transcription in the absence of its cognate inducer or derepressor) or a tissue-specific promoter. Methodologies for preparing, testing and using these and related agents are known in the art. See, e.g., Ausubel (Ed.), Current Protocols in Molecular Biology (2007 John Wiley & Sons, NY); Rosenzweig and Nabel (Eds), Current Protocols in Human Genetics (esp. Ch. 13 therein, "Delivery Systems for Gene Therapy", 2008 John Wiley & Sons, NY); Abell, Advances in Amino Acid Mimetics and Peptidomimetics, 1997 Elsevier, NY. In another embodiment, gene therapy agents may encompass zinc finger nuclease (ZFN) or transcription activator-like effector nuclease (TALEN) strategies, see for example: Urnov et al. (2010), Nature Reviews Genetics 11(9):636-46; Yusa et al. (2011), Nature 478(7369):391-4; Bedell et al. (2012), Nature ePub September 23, PubMed ID 23000899.

As a non-limiting example, one such embodiment contemplates introduction of a gene therapy agent for treating ASD (e.g., an engineered therapeutic virus, a therapeutic agent-carrying nanoparticle, etc.) to one or more injection sites in a subject, without the need for imaging, surgery, or histology on biopsy specimens. Of course, periodic monitoring of the circulation for leaked therapeutic agent and/or subsequent analysis of a biopsy specimen, e.g., to assess the effects of the agent on the target tissue, can also be considered. A gene therapy includes a therapeutic polynucleotide administered before, after, or at the same time as any other therapy described herein. In some embodiments, therapeutic genes may include an antisense version of a biomarker disclosed herein, a sequence of a biomarker described herein, or an inhibitor of a biomarker disclosed herein.

Methods of Treatment

Some embodiments of the present disclosure relates to methods of using pharmaceutical compositions and kits comprising agents that can inhibit a developmental disorder associated biomarker or a developmental disorder associated biomarkers to inhibit or decrease a developmental disorder progression. Another embodiment of the present disclosure provides methods, pharmaceutical compositions, and kits for the treatment of animal subjects. The term "animal subject" as used herein includes humans as well as other mammals. The term "treating" as used herein includes achieving a therapeutic benefit and/or a prophylactic benefit. By therapeutic benefit is meant eradication or amelioration of the underlying viral infection. Also, a therapeutic benefit is achieved with the eradication or amelioration of one or more of the physiological symptoms associated a developmental disorder such that an improvement is observed in the animal subject, notwithstanding the fact that the animal subject can still be afflicted with a developmental disorder.

For embodiments where a prophylactic benefit is desired, a pharmaceutical composition of the disclosure can be administered to a subject at risk of developing a developmental disorder, or to a subject reporting one or more of the physiological symptoms of a developmental disorder, even though a screening of the condition cannot have been made. Administration can prevent a developmental disorder from developing, or it can reduce, lessen, shorten and/or otherwise ameliorate the progression of a developmental disorder, or symptoms that develop. The pharmaceutical composition can modulate or target a developmental disorder associated biomarker. Wherein, the term modulate includes inhibition of a developmental disorder associated biomarkers or alternatively activation of a developmental disorder associated biomarkers.

Reducing the activity of a developmental disorder associated biomarkers is also referred to as "inhibiting" the a developmental disorder associated biomarkers. The term "inhibits" and its grammatical conjugations, such as "inhibitory," do not require complete inhibition, but refer to a reduction in a developmental disorder associated biomarkers' activities. In some embodiments such reduction is by at least 5%, at least 10%, at least 20%, at least 30%, at least 40%, at least 50%, at least 75%, at least 90%, and can be by at least 95% of the activity of the enzyme or other biologically important molecular process in the absence of the inhibitory effect, e.g., in the absence of an inhibitor. Conversely, the phrase "does not inhibit" and its grammatical conjugations refer to situations where there is less than 20%, less than 10%, and can be less than 5%, of reduction in enzyme or other biologically important molecular activity in the presence of the agent. Further the phrase "does not substantially inhibit" and its grammatical conjugations refer to situations where there is less than 30%, less than 20%, and in some embodiments less than 10% of reduction in enzyme or other biologically important molecular activity in the presence of the agent.

Increasing the activity a developmental disorderand/or function of polypeptides and/or nucleic acids found to be associated with one or more developmentaldisorders, is also referred to as "activating" the polypeptides and/or nucleic acids. The term "activated" and its grammatical conjugations, such as "activating," do not require complete activation, but refer to an increase in a developmental disorder associated biomarkers' activities. In some embodiments such increase is by at least 5%, at least 10%, at least 20%, at least 30%, at least 40%, at least 50%, at least 60%, at least 70%, at least 75%, at least 80%, at least 85%, at least 90%, and can be by at least 95% of the activity of the enzyme or other biologically important molecular process in the absence of the activation effect, e.g., in the absence of an activator. Conversely, the phrase "does not activate" and its grammatical conjugations refer to situations where there can be less than 20%, less than 10%, and less than 5%, of an increase in enzyme or other biologically important molecular activity in the presence of the agent. Further the phrase "does not substantially activate" and its grammatical conjugations refer to situations where there is less than 30%, less than 20%, and in some embodiments less than 10% of an increase in enzyme or other biologically important molecular activity in the presence of the agent.

The ability to reduce enzyme activity is a measure of the potency or the activity of an agent, or combination of agents, towards or against the enzyme or other biologically important molecular process. Potency can be measured by cell free, whole cell and/or in vivo assays in terms of IC50, Ki and/or ED50 values. An IC50 value represents the concentration of an agent required to inhibit enzyme activity by half (50%) under a given set of conditions. A Ki value represents the equilibrium affinity constant for the binding of an inhibiting agent to the enzyme or other relevant biomolecule. An ED50 value represents the dose of an agent required to affect a half-maximal response in a biological assay. Further details of these measures will be appreciated by those of ordinary skill in the art, and can be found in standard texts on biochemistry, enzymology, and the like.

The present disclosure also includes kits that can be used to treat developmental disorders. These kits comprise an agent or combination of agents that inhibits a developmental disorder associated biomarker or a developmental disorder associated biomarkers and in some embodiments instructions teaching the use of the kit according to the various methods and approaches described herein. Such kits can also include information, such as scientific literature references, package insert materials, clinical trial results, and/or summaries of these and the like, which indicate or establish the activities and/or advantages of the agent. Such information can be based on the results of various studies, for example, studies using experimental animals involving in vivo models and studies based on human clinical trials. Kits described herein can be provided, marketed and/or promoted to health providers, including physicians, nurses, pharmacists, formulary officials, and the like.

In some aspects a host cell can be used for testing or administering therapeutics. In some embodiments, a host cell can comprise a nucleic acid comprising expression control sequences operably-linked to a coding region. The host cell can be natural or non-natural. The non-natural host used in aspects of the method can be any cell capable of expressing a nucleic acid of the disclosure including, bacterial cells, fungal cells, insect cells, mammalian cells and plant cells. In some aspects the natural host is a mammalian tissue cell and the non-natural host is a different mammalian tissue cell. Other aspects of the method include a natural host that is a first cell normally residing in a first mammalian species and the non-natural host is a second cell normally residing in a second mammalian species. In another alternative aspect, the method uses a first cell and the second cell that are from the same tissue type. In those aspects of the method where the coding region encodes a mammalian polypeptide, the mammalian polypeptide may be a hormone. In other aspects the coding region may encode a neuropeptide, an antibody, an antimetabolite, or a polypeptide or nucleotide therapeutic.

Expression control sequences can be those nucleotide sequences, both 5' and 3' to a coding region, that are required for the transcription and translation of the coding region in a host organism. Regulatory sequences include a promoter, ribosome binding site, optional inducible elements and sequence elements required for efficient 3' processing, including polyadenylation. When the structural gene has been isolated from genomic DNA, the regulatory sequences also include those intronic sequences required for splicing of the introns as part of mRNA formation in the target host.

Formulations, Routes of Administration, and Effective Doses

Yet another aspect of the present disclosure relates to formulations, routes of administration and effective doses for pharmaceutical compositions comprising an agent or combination of agents of the instant disclosure. Such pharmaceutical compositions can be used to treat a developmental disorder progression and a developmental disorder associated symptoms as described above.

Compounds of the disclosure can be administered as pharmaceutical formulations including those suitable for oral (including buccal and sub-lingual), rectal, nasal, topical, transdermal patch, pulmonary, vaginal, suppository, or parenteral (including intramuscular, intraarterial, intrathecal, intradermal, intraperitoneal, subcutaneous and intravenous) administration or in a form suitable for administration by aerosolization, inhalation or insufflation. General information on drug delivery systems can be found in Ansel et al., Pharmaceutical Dosage Forms and Drug Delivery Systems (Lippencott Williams & Wilkins, Baltimore Md. (1999).

In various embodiments, the pharmaceutical composition includes carriers and excipients (including but not limited to buffers, carbohydrates, mannitol, polypeptides, amino acids, antioxidants, bacteriostats, chelating agents, suspending agents, thickening agents and/or preservatives), water, oils including those of petroleum, animal, vegetable or synthetic origin, such as peanut oil, soybean oil, mineral oil, sesame oil and the like, saline solutions, aqueous dextrose and glycerol solutions, flavoring agents, coloring agents, detackifiers and other acceptable additives, adjuvants, or binders, other pharmaceutically acceptable auxiliary substances to approximate physiological conditions, such as pH buffering agents, tonicity adjusting agents, emulsifying agents, wetting agents and the like. Examples of excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. In some embodiments, the pharmaceutical preparation is substantially free of preservatives. In other embodiments, the pharmaceutical preparation can contain at least one preservative. General methodology on pharmaceutical dosage forms is found in Ansel et al., Pharmaceutical Dosage Forms and Drug Delivery Systems (Lippencott, Williams, & Wilkins, Baltimore Md. (1999)). It can be recognized that, while any suitable carrier known to those of ordinary skill in the art can be employed to administer the compositions of this disclosure, the type of carrier can vary depending on the mode of administration.

Compounds can also be encapsulated within liposomes using well-known technology. Biodegradable microspheres can also be employed as carriers for the pharmaceutical compositions of this disclosure. Suitable biodegradable microspheres are disclosed, for example, in U.S. Pat. Nos. 4,897,268, 5,075,109, 5,928,647, 5,811,128, 5,820,883, 5,853,763, 5,814,344 and 5,942,252.

The compound can be administered in liposomes or microspheres (or microparticles). Methods for preparing liposomes and microspheres for administration to a subject are well known to those of skill in the art. U.S. Pat. No. 4,789,734, the contents of which are hereby incorporated by reference, describes methods for encapsulating biological materials in liposomes. Essentially, the material is dissolved in an aqueous solution, the appropriate phospholipids and lipids added, and along with surfactants if required, and the material dialyzed or sonicated, as necessary. A review of known methods is provided by G. Gregoriadis, Chapter 14, "Liposomes," Drug Carriers in Biology and Medicine, pp. 2.sup.87-341 (Academic Press, 1979).

Microspheres formed of polymers or polypeptides are well known to those skilled in the art, and can be tailored for passage through the gastrointestinal tract directly into the blood stream. Alternatively, the compound can be incorporated and the microspheres, or composite of microspheres, implanted for slow release over a period of time ranging from days to months. See, for example, U.S. Pat. Nos. 4,906,474, 4,925,673 and 3,625,214, and Jein, TIPS 19:155-157 (1998), the contents of which are hereby incorporated by reference.

The concentration of drug can be adjusted, the pH of the solution buffered and the isotonicity adjusted to be compatible with intravenous injection, as is well known in the art.

The compounds of the disclosure can be formulated as a sterile solution or suspension, in suitable vehicles, well known in the art. The pharmaceutical compositions can be sterilized by conventional, well-known sterilization techniques, or can be sterile filtered. The resulting aqueous solutions can be packaged for use as is, or lyophilized, the lyophilized preparation being combined with a sterile solution prior to administration. Suitable formulations and additional carriers are described in Remington "The Science and Practice of Pharmacy" (20th Ed., Lippincott Williams &

Wilkins, Baltimore Md.), the teachings of which are incorporated by reference in their entirety herein.

The agents or their pharmaceutically acceptable salts can be provided alone or in combination with one or more other agents or with one or more other forms. For example, a formulation can comprise one or more agents in particular proportions, depending on the relative potencies of each agent and the intended indication. For example, in compositions for targeting two different host targets, and where potencies are similar, about a 1:1 ratio of agents can be used. The two forms can be formulated together, in the same dosage unit e.g., in one cream, suppository, tablet, capsule, aerosol spray, or packet of powder to be dissolved in a beverage; or each form can be formulated in a separate unit, e.g., two creams, two suppositories, two tablets, two capsules, a tablet and a liquid for dissolving the tablet, two aerosol sprays, or a packet of powder and a liquid for dissolving the powder, etc.

The term "pharmaceutically acceptable salt" means those salts which retain the biological effectiveness and properties of the agents used in the present disclosure, and which are not biologically or otherwise undesirable. For example, a pharmaceutically acceptable salt does not interfere with the beneficial effect of an agent of the disclosure in inhibiting a developmental disorder associated biomarkers' components Typical salts are those of the inorganic ions, such as, for example, sodium, potassium, calcium, magnesium ions, and the like. Such salts include salts with inorganic or organic acids, such as hydrochloric acid, hydrobromic acid, phosphoric acid, nitric acid, sulfuric acid, methanesulfonic acid, p toluenesulfonic acid, acetic acid, fumaric acid, succinic acid, lactic acid, mandelic acid, malic acid, citric acid, tartaric acid or maleic acid. In addition, if the agent(s) contain a carboxy group or other acidic group, it can be converted into a pharmaceutically acceptable addition salt with inorganic or organic bases. Examples of suitable bases include sodium hydroxide, potassium hydroxide, ammonia, cyclohexylamine, dicyclohexyl-amine, ethanolamine, diethanolamine, triethanolamine, and the like.

A pharmaceutically acceptable ester or amide refers to those which retain biological effectiveness and properties of the agents used in the present disclosure, and which are not biologically or otherwise undesirable. For example, the ester or amide does not interfere with the beneficial effect of an agent of the disclosure in inhibiting a developmental disorder associated biomarkers' components. Typical esters include ethyl, methyl, isobutyl, ethylene glycol, and the like. Typical amides include unsubstituted amides, alkyl amides, dialkyl amides, and the like.

In some embodiments, an agent can be administered in combination with one or more other compounds, forms, and/or agents, e.g., as described above. Pharmaceutical compositions comprising combinations of a developmental disorder associated biomarkers' inhibitors with one or more other active agents can be formulated to comprise certain molar ratios. For example, molar ratios of about 99:1 to about 1:99 of a developmental disorder associated biomarkers' inhibitors to the other active agent can be used. In some subset of the embodiments, the range of molar ratios of developmental disorder associated biomarkers' inhibitors: other active agents are selected from about 80:20 to about 20:80; about 75:25 to about 25:75, about 70:30 to about 30:70, about 66:33 to about 33:66, about 60:40 to about 40:60; about 50:50; and about 90:10 to about 10:90. The molar ratio of developmental disorder associated biomarkers' inhibitors: other active agents can be about 1:9, and in some embodiments can be about 1:1. The two agents, forms and/or compounds can be formulated together, in the same dosage unit e.g., in one cream, suppository, tablet, capsule, or packet of powder to be dissolved in a beverage; or each agent, form, and/or compound can be formulated in separate units, e.g., two creams, suppositories, tablets, two capsules, a tablet and a liquid for dissolving the tablet, an aerosol spray a packet of powder and a liquid for dissolving the powder, etc.

If necessary or desirable, the agents and/or combinations of agents can be administered with still other agents. The choice of agents that can be co-administered with the agents and/or combinations of agents of the instant disclosure can depend, at least in part, on the condition being treated. Agents of particular use in the formulations of the present disclosure include, for example, any agent having a therapeutic effect for a viral infection, including, e.g., drugs used to treat inflammatory conditions. For example, in treatments for influenza, in some embodiments formulations of the instant disclosure can additionally contain one or more conventional anti-inflammatory drugs, such as an NSAID, e.g., ibuprofen, naproxen, acetaminophen, ketoprofen, or aspirin. In some alternative embodiments for the treatment of influenza formulations of the instant disclosure can additionally contain one or more conventional influenza antiviral agents, such as amantadine, rimantadine, zanamivir, and oseltamivir. In treatments for retroviral infections, such as HIV, formulations of the instant disclosure can additionally contain one or more conventional antiviral drug, such as protease inhibitors (lopinavir/ritonavir {Kaletra}, indinavir {Crixivan}, ritonavir {Norvir}, nelfinavir {Viracept}, saquinavir hard gel capsules {Invirase}, atazanavir {Reyataz}, amprenavir {Agenerase}, fosamprenavir {Telzir}, tipranavir{Aptivus}), reverse transcriptase inhibitors, including non-Nucleoside and Nucleoside/nucleotide inhibitors (AZT {zidovudine, Retrovir}, ddI {didanosine, Videx}, 3TC {lamivudine, Epivir}, d4T {stavudine, Zerit}, abacavir {Ziagen}, FTC {emtricitabine, Emtriva}, tenofovir {Viread}, efavirenz {Sustiva} and nevirapine {Viramune}), fusion inhibitors T20 {enfuvirtide, Fuzeon}, integrase inhibitors (MK-0518 and GS-9137), and maturation inhibitors (PA-457 {Bevirimat}). As another example, formulations can additionally contain one or more supplements, such as vitamin C, E or other anti-oxidants.

The agent(s) (or pharmaceutically acceptable salts, esters or amides thereof) can be administered per se or in the form of a pharmaceutical composition wherein the active agent(s) is in an admixture or mixture with one or more pharmaceutically acceptable carriers. A pharmaceutical composition, as used herein, can be any composition prepared for administration to a subject. Pharmaceutical compositions for use in accordance with the present disclosure can be formulated in conventional manner using one or more physiologically acceptable carriers, comprising excipients, diluents, and/or auxiliaries, e.g., which facilitate processing of the active agents into preparations that can be administered. Proper formulation can depend at least in part upon the route of administration chosen. The agent(s) useful in the present disclosure, or pharmaceutically acceptable salts, esters, or amides thereof, can be delivered to a subject using a number of routes or modes of administration, including oral, buccal, topical, rectal, transdermal, transmucosal, subcutaneous, intravenous, and intramuscular applications, as well as by inhalation.

For oral administration, the agents can be formulated readily by combining the active agent(s) with pharmaceutically acceptable carriers well known in the art. Such carriers enable the agents of the disclosure to be formulated as tablets, including chewable tablets, pills, dragees, capsules, lozenges, hard candy, liquids, gels, syrups, slurries, powders, suspensions, elixirs, wafers, and the like, for oral ingestion by a subject to be treated. Such formulations can comprise pharmaceutically acceptable carriers including solid diluents or fillers, sterile aqueous media and various non-toxic organic solvents. A solid carrier can be one or more substances which can also act as diluents, flavoring agents, solubilizers, lubricants, suspending agents, binders, preservatives, tablet disintegrating agents, or an encapsulating material. In powders, the carrier generally is a finely divided solid which is a mixture with the finely divided active component. In tablets, the active component generally is mixed with the carrier having the necessary binding capacity in suitable proportions and compacted in the shape and size desired. The powders and tablets preferably contain from about one (1) to about seventy (70) percent of the active compound. Suitable carriers include but are not limited to magnesium carbonate, magnesium stearate, talc, sugar, lactose, pectin, dextrin, starch, gelatin, tragacanth, methylcellulose, sodium carboxymethylcellulose, a low melting wax, cocoa butter, and the like. Generally, the agents of the disclosure can be included at concentration levels ranging from about 0.5%, about 5%, about 10%, about 20%, or about 30% to about 50%, about 60%, about 70%, about 80% or about 90% by weight of the total composition of oral dosage forms, in an amount sufficient to provide a desired unit of dosage.

Aqueous suspensions for oral use can contain agent(s) of this disclosure with pharmaceutically acceptable excipients, such as a suspending agent (e.g., methyl cellulose), a wetting agent (e.g., lecithin, lysolecithin and/or a long-chain fatty alcohol), as well as coloring agents, preservatives, flavoring agents, and the like.

In some embodiments, oils or non-aqueous solvents can be used to bring the agents into solution, due to, for example, the presence of large lipophilic moieties. Alternatively, emulsions, suspensions, or other preparations, for example, liposomal preparations, can be used. With respect to liposomal preparations, any known methods for preparing liposomes for treatment of a condition can be used. See, for example, Bangham et al., J. Mol. Biol. 23: 238-252 (1965) and Szoka et al., Proc. Natl Acad. Sci. USA 75: 4194-4198 (1978), incorporated herein by reference. Ligands can also be attached to the liposomes to direct these compositions to particular sites of action. Agents of this disclosure can also be integrated into foodstuffs, e.g., cream cheese, butter, salad dressing, or ice cream to facilitate solubilization, administration, and/or compliance in certain subject populations.

Pharmaceutical preparations for oral use can be obtained as a solid excipient, optionally grinding a resulting mixture, and processing the mixture of granules, after adding suitable auxiliaries, if desired, to obtain tablets or dragee cores. Suitable excipients are, in particular, fillers such as sugars, including lactose, sucrose, mannitol, or sorbitol; flavoring elements, cellulose preparations such as, for example, maize starch, wheat starch, rice starch, potato starch, gelatin, gum tragacanth, methyl cellulose, hydroxypropylmethyl cellulose, sodium carboxymethylcellulose, and/or polyvinyl pyrrolidone (PVP). If desired, disintegrating agents can be added, such as the cross linked polyvinyl pyrrolidone, agar, or alginic acid or a salt thereof such as sodium alginate. The agents can also be formulated as a sustained release preparation.

Dragee cores can be provided with suitable coatings. For this purpose, concentrated sugar solutions can be used, which can optionally contain gum arabic, talc, polyvinyl pyrrolidone, carbopol gel, polyethylene glycol, and/or titanium dioxide, lacquer solutions, and suitable organic solvents or solvent mixtures. Dyestuffs or pigments can be added to the tablets or dragee coatings for identification or to characterize different combinations of active agents.

Pharmaceutical preparations that can be used orally include push fit capsules made of gelatin, as well as soft, sealed capsules made of gelatin and a plasticizer, such as glycerol or sorbitol. The push fit capsules can contain the active ingredients in admixture with filler such as lactose, binders such as starches, and/or lubricants such as talc or magnesium stearate and, optionally, stabilizers. In soft capsules, the active agents can be dissolved or suspended in suitable liquids, such as fatty oils, liquid paraffin, or liquid polyethylene glycols. In addition, stabilizers can be added. All formulations for oral administration should be in dosages suitable for administration.

Other forms suitable for oral administration include liquid form preparations including emulsions, syrups, elixirs, aqueous solutions, aqueous suspensions, or solid form preparations which are intended to be converted shortly before use to liquid form preparations. Emulsions can be prepared in solutions, for example, in aqueous propylene glycol solutions or can contain emulsifying agents, for example, such as lecithin, sorbitan monooleate, or acacia. Aqueous solutions can be prepared by dissolving the active component in water and adding suitable colorants, flavors, stabilizers, and thickening agents. Aqueous suspensions can be prepared by dispersing the finely divided active component in water with viscous material, such as natural or synthetic gums, resins, methylcellulose, sodium carboxymethylcellulose, and other well known suspending agents. Suitable fillers or carriers with which the compositions can be administered include agar, alcohol, fats, lactose, starch, cellulose derivatives, polysaccharides, polyvinylpyrrolidone, silica, sterile saline and the like, or mixtures thereof used in suitable amounts. Solid form preparations include solutions, suspensions, and emulsions, and can contain, in addition to the active component, colorants, flavors, stabilizers, buffers, artificial and natural sweeteners, dispersants, thickeners, solubilizing agents, and the like.

A syrup or suspension can be made by adding the active compound to a concentrated, aqueous solution of a sugar, e.g., sucrose, to which can also be added any accessory ingredients. Such accessory ingredients can include flavoring, an agent to retard crystallization of the sugar or an agent to increase the solubility of any other ingredient, e.g., as a polyhydric alcohol, for example, glycerol or sorbitol.

When formulating compounds of the disclosure for oral administration, it can be desirable to utilize gastroretentive formulations to enhance absorption from the gastrointestinal (GI) tract. A formulation which is retained in the stomach for several hours can release compounds of the disclosure slowly and provide a sustained release that can be preferred in some embodiments of the disclosure. Disclosure of such gastro-retentive formulations are found in Klausner, E. A.; Lavy, E.; Barta, M.; Cserepes, E.; Friedman, M.; Hoffman, A. 2003 "Novel gastroretentive dosage forms: evaluation of gastroretentivity and its effect on levodopa in humans." Pharm. Res. 20, 1466-73, Hoffman, A.; Stepensky, D.; Lavy, E.; Eyal, S. Klausner, E.; Friedman, M. 2004 "Pharmacokinetic and pharmacodynamic aspects of gastroretentive dosage forms" Int. J. Pharm. 11, 141-53, Streubel, A.; Siepmann, J.; Bodmeier, R.; 2006 "Gastroretentive drug delivery systems" Expert Opin. Drug Deliver. 3, 217-3, and Chavanpatil, M. D.; Jain, P.; Chaudhari, S.; Shear, R.; Vavia, P. R. "Novel sustained release, swellable and bioadhesive gastroretentive drug delivery system for olfoxacin" Int. J. Pharm. 2006. Expandable, floating and bioadhesive techniques can be utilized to maximize absorption of the compounds of the disclosure.

The compounds of the disclosure can be formulated for parenteral administration (e.g., by injection, for example, bolus injection or continuous infusion) and can be presented in unit dose form in ampoules, pre-filled syringes, small volume infusion or in multi-dose containers with an added preservative. The compositions can take such forms as suspensions, solutions, or emulsions in oily or aqueous vehicles, for example, solutions in aqueous polyethylene glycol.

For injectable formulations, the vehicle can be chosen from those known in art to be suitable, including aqueous solutions or oil suspensions, or emulsions, with sesame oil, corn oil, cottonseed oil, or peanut oil, as well as elixirs, mannitol, dextrose, or a sterile aqueous solution, and similar pharmaceutical vehicles. The formulation can also comprise polymer compositions which are biocompatible, biodegradable, such as poly(lactic-co-glycolic) acid. These materials can be made into micro or nanospheres, loaded with drug and further coated or derivatized to provide superior sustained release performance. Vehicles suitable for periocular or intraocular injection include, for example, suspensions of therapeutic agent in injection grade water, liposomes and vehicles suitable for lipophilic substances. Other vehicles for periocular or intraocular injection are well known in the art.

In some embodiments, the composition is formulated in accordance with routine procedures as a pharmaceutical composition adapted for intravenous administration to human beings. Typically, compositions for intravenous administration are solutions in sterile isotonic aqueous buffer. Where necessary, the composition can also include a solubilizing agent and a local anesthetic such as lidocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients can be mixed prior to administration.

When administration is by injection, the active compound can be formulated in aqueous solutions, specifically in physiologically compatible buffers such as Hanks solution, Ringer's solution, or physiological saline buffer. The solution can contain formulatory agents such as suspending, stabilizing and/or dispersing agents. Alternatively, the active compound can be in powder form for constitution with a suitable vehicle, e.g., sterile pyrogen-free water, before use. In some embodiments, the pharmaceutical composition does not comprise an adjuvant or any other substance added to enhance the immune response stimulated by the peptide. In some embodiments, the pharmaceutical composition comprises a substance that inhibits an immune response to the peptide. Methods of formulation are known in the art, for example, as disclosed in Remington's Pharmaceutical Sciences, latest edition, Mack Publishing Co., Easton P.

In addition to the formulations described previously, the agents can also be formulated as a depot preparation. Such long acting formulations can be administered by implantation or transcutaneous delivery (for example, subcutaneously or intramuscularly), intramuscular injection or use of a transdermal patch. Thus, for example, the agents can be formulated with suitable polymeric or hydrophobic materials (for example, as an emulsion in an acceptable oil) or ion exchange resins, or as sparingly soluble derivatives, for example, as a sparingly soluble salt.

In some embodiments, pharmaceutical compositions comprising one or more agents of the present disclosure exert local and regional effects when administered topically or injected at or near particular sites of infection. Direct topical application, e.g., of a viscous liquid, solution, suspension, dimethylsulfoxide (DMSO)-based solutions, liposomal formulations, gel, jelly, cream, lotion, ointment, suppository, foam, or aerosol spray, can be used for local administration, to produce for example, local and/or regional effects. Pharmaceutically appropriate vehicles for such formulation include, for example, lower aliphatic alcohols, polyglycols (e.g., glycerol or polyethylene glycol), esters of fatty acids, oils, fats, silicones, and the like. Such preparations can also include preservatives (e.g., p-hydroxybenzoic acid esters) and/or antioxidants (e.g., ascorbic acid and tocopherol). See also Dermatological Formulations: Percutaneous absorption, Barry (Ed.), Marcel Dekker Incl, 1983.

Pharmaceutical compositions of the present disclosure can contain a cosmetically or dermatologically acceptable carrier. Such carriers are compatible with skin, nails, mucous membranes, tissues and/or hair, and can include any conventionally used cosmetic or dermatological carrier meeting these requirements. Such carriers can be readily selected by one of ordinary skill in the art. In formulating skin ointments, an agent or combination of agents of the instant disclosure can be formulated in an oleaginous hydrocarbon base, an anhydrous absorption base, a water-in-oil absorption base, an oil-in-water water-removable base and/or a water-soluble base. Examples of such carriers and excipients include, but are not limited to, humectants (e.g., urea), glycols (e.g., propylene glycol), alcohols (e.g., ethanol), fatty acids (e.g., oleic acid), surfactants (e.g., isopropyl myristate and sodium lauryl sulfate), pyrrolidones, glycerol monolaurate, sulfoxides, terpenes (e.g., menthol), amines, amides, alkanes, alkanols, water, calcium carbonate, calcium phosphate, various sugars, starches, cellulose derivatives, gelatin, and polymers such as polyethylene glycols.

Ointments and creams can, for example, be formulated with an aqueous or oily base with the addition of suitable thickening and/or gelling agents. Lotions can be formulated with an aqueous or oily base and can in general also containing one or more emulsifying agents, stabilizing agents, dispersing agents, suspending agents, thickening agents, or coloring agents. The construction and use of transdermal patches for the delivery of pharmaceutical agents is well known in the art. See, e.g., U.S. Pat. Nos. 5,023,252, 4,992,445 and 5,001,139. Such patches can be constructed for continuous, pulsatile, or on demand delivery of pharmaceutical agents.

Lubricants which can be used to form pharmaceutical compositions and dosage forms of the disclosure include, but are not limited to, calcium stearate, magnesium stearate, mineral oil, light mineral oil, glycerin, sorbitol, mannitol, polyethylene glycol, other glycols, stearic acid, sodium lauryl sulfate, talc, hydrogenated vegetable oil (e.g., peanut oil, cottonseed oil, sunflower oil, sesame oil, olive oil, corn oil, and soybean oil), zinc stearate, ethyl oleate, ethyl laureate, agar, or mixtures thereof. Additional lubricants include, for example, a syloid silica gel, a coagulated aerosol of synthetic silica, or mixtures thereof. A lubricant can optionally be added, in an amount of less than about 1 weight percent of the pharmaceutical composition.

The compositions according to the present disclosure can be in any form suitable for topical application, including aqueous, aqueous-alcoholic or oily solutions, lotion or serum dispersions, aqueous, anhydrous or oily gels, emulsions obtained by dispersion of a fatty phase in an aqueous phase (0/W or oil in water) or, conversely, (W/O or water in oil), microemulsions or alternatively microcapsules, microparticles or lipid vesicle dispersions of ionic and/or nonionic type. These compositions can be prepared according to conventional methods. Other than the agents of the disclosure, the amounts of the various constituents of the compositions according to the disclosure are those conventionally used in the art. These compositions in particular constitute protection, treatment or care creams, milks, lotions, gels or foams for the face, for the hands, for the body and/or for the mucous membranes, or for cleansing the skin. The compositions can also consist of solid preparations constituting soaps or cleansing bars.

Compositions of the present disclosure can also contain adjuvants common to the cosmetic and dermatological fields, such as hydrophilic or lipophilic gelling agents, hydrophilic or lipophilic active agents, preserving agents, antioxidants, solvents, fragrances, fillers, sunscreens, odor-absorbers and dyestuffs. The amounts of these various adjuvants are those conventionally used in the fields considered and, for example, are from about 0.01% to about 20% of the total weight of the composition. Depending on their nature, these adjuvants can be introduced into the fatty phase, into the aqueous phase and/or into the lipid vesicles.

In some embodiments, ocular viral infections can be effectively treated with ophthalmic solutions, suspensions, ointments or inserts comprising an agent or combination of agents of the present disclosure. Eye drops can be prepared by dissolving the active ingredient in a sterile aqueous solution such as physiological saline, buffering solution, etc., or by combining powder compositions to be dissolved before use. Other vehicles can be chosen, as is known in the art, including but not limited to: balance salt solution, saline solution, water soluble polyethers such as polyethyene glycol, polyvinyls, such as polyvinyl alcohol and povidone, cellulose derivatives such as methylcellulose and hydroxypropyl methylcellulose, petroleum derivatives such as mineral oil and white petrolatum, animal fats such as lanolin, polymers of acrylic acid such as carboxypolymethylene gel, vegetable fats such as peanut oil and polysaccharides such as dextrans, and glycosaminoglycans such as sodium hyaluronate. If desired, additives ordinarily used in the eye drops can be added. Such additives include isotonizing agents (e.g., sodium chloride, etc.), buffer agent (e.g., boric acid, sodium monohydrogen phosphate, sodium dihydrogen phosphate, etc.), preservatives (e.g., benzalkonium chloride, benzethonium chloride, chlorobutanol, etc.), thickeners (e.g., saccharide such as lactose, mannitol, maltose, etc.; e.g., hyaluronic acid or its salt such as sodium hyaluronate, potassium hyaluronate, etc.; e.g., mucopolysaccharide such as chondroitin sulfate, etc.; e.g., sodium polyacrylate, carboxyvinyl polymer, crosslinked polyacrylate, polyvinyl alcohol, polyvinyl pyrrolidone, methyl cellulose, hydroxy propyl methylcellulose, hydroxyethyl cellulose, carboxymethyl cellulose, hydroxy propyl cellulose or other agents known to those skilled in the art).

The solubility of the components of the present compositions can be enhanced by a surfactant or other appropriate co-solvent in the composition. Such cosolvents include polysorbate 20, 60, and 80, Pluronic F68, F-84 and P-103, cyclodextrin, or other agents known to those skilled in the art. Such co-solvents can be employed at a level of from about 0.01% to 2% by weight.

The compositions of the disclosure can be packaged in multidose form. Preservatives can be preferred to prevent microbial contamination during use. Suitable preservatives include: benzalkonium chloride, thimerosal, chlorobutanol, methyl paraben, propyl paraben, phenylethyl alcohol, edetate disodium, sorbic acid, Onamer M, or other agents known to those skilled in the art. In the prior art ophthalmic products, such preservatives can be employed at a level of from 0.004% to 0.02%. In the compositions of the present application the preservative, preferably benzalkonium chloride, can be employed at a level of from 0.001% to less than 0.01%, e.g. from 0.001% to 0.008%, preferably about 0.005% by weight. It has been found that a concentration of benzalkonium chloride of 0.005% can be sufficient to preserve the compositions of the present disclosure from microbial attack.

In some embodiments, developmental disorder associated symptoms of the ear can be effectively treated with otic solutions, suspensions, ointments or inserts comprising an agent or combination of agents of the present disclosure.

In some embodiments, the agents of the present disclosure are delivered in soluble rather than suspension form, which allows for more rapid and quantitative absorption to the sites of action. In general, formulations such as jellies, creams, lotions, suppositories and ointments can provide an area with more extended exposure to the agents of the present disclosure, while formulations in solution, e.g., sprays, provide more immediate, short-term exposure.

In some embodiments relating to topical/local application, the pharmaceutical compositions can include one or more penetration enhancers. For example, the formulations can comprise suitable solid or gel phase carriers or excipients that increase penetration or help delivery of agents or combinations of agents of the disclosure across a permeability barrier, e.g., the skin. Many of these penetration-enhancing compounds are known in the art of topical formulation, and include, e.g., water, alcohols (e.g., terpenes like methanol, ethanol, 2-propanol), sulfoxides (e.g., dimethyl sulfoxide, decylmethyl sulfoxide, tetradecylmethyl sulfoxide), pyrrolidones (e.g., 2-pyrrolidone, N-methyl-2-pyrrolidone, N-(2-hydroxyethyl)pyrrolidone), laurocapram, acetone, dimethylacetamide, dimethylformamide, tetrahydrofurfuryl alcohol, L-α-amino acids, anionic, cationic, amphoteric or nonionic surfactants (e.g., isopropyl myristate and sodium lauryl sulfate), fatty acids, fatty alcohols (e.g., oleic acid), amines, amides, clofibric acid amides, hexamethylene lauramide, proteolytic enzymes, α-bisabolol, d-limonene, urea and N,N-diethyl-m-toluamide, and the like. Additional examples include humectants (e.g., urea), glycols (e.g., propylene glycol and polyethylene glycol), glycerol monolaurate, alkanes, alkanols, ORGELASE, calcium carbonate, calcium phosphate, various sugars, starches, cellulose derivatives, gelatin, and/or other polymers. In some embodiments, the pharmaceutical compositions can include one or more such penetration enhancers.

In some embodiments, the pharmaceutical compositions for local/topical application can include one or more antimicrobial preservatives such as quaternary ammonium compounds, organic mercurials, p-hydroxy benzoates, aromatic alcohols, chlorobutanol, and the like.

Gastrointestinal developmental disorder symptoms can be effectively treated with orally- or rectally delivered solutions, suspensions, ointments, enemas and/or suppositories comprising an agent or combination of agents of the present disclosure.

Respiratory developmental disorder symptoms can be effectively treated with aerosol solutions, suspensions or dry powders comprising an agent or combination of agents of the present disclosure. Administration by inhalation is particularly useful in treating viral infections of the lung, such as influenza. The aerosol can be administered through the respiratory system or nasal passages. For example, one skilled in the art can recognize that a composition of the present disclosure can be suspended or dissolved in an appropriate carrier, e.g., a pharmaceutically acceptable propellant, and administered directly into the lungs using a nasal spray or inhalant. For example, an aerosol formulation comprising a developmental disorder associated biomarkers' inhibitors can be dissolved, suspended or emulsified in a propellant or a mixture of solvent and propellant, e.g., for administration as a nasal spray or inhalant. Aerosol formulations can contain any acceptable propellant under pressure, such as a cosmetically or dermatologically or pharmaceutically acceptable propellant, as conventionally used in the art.

An aerosol formulation for nasal administration is generally an aqueous solution designed to be administered to the nasal passages in drops or sprays. Nasal solutions can be similar to nasal secretions in that they are generally isotonic and slightly buffered to maintain a pH of about 5.5 to about 6.5, although pH values outside of this range can additionally be used. Antimicrobial agents or preservatives can also be included in the formulation.

An aerosol formulation for inhalations and inhalants can be designed so that the agent or combination of agents of the present disclosure is carried into the respiratory tree of the subject when administered by the nasal or oral respiratory route. Inhalation solutions can be administered, for example, by a nebulizer. Inhalations or insufflations, comprising finely powdered or liquid drugs, can be delivered to the respiratory system as a pharmaceutical aerosol of a solution or suspension of the agent or combination of agents in a propellant, e.g., to aid in disbursement. Propellants can be liquefied gases, including halocarbons, for example, fluorocarbons such as fluorinated chlorinated hydrocarbons, hydrochlorofluorocarbons, and hydrochlorocarbons, as well as hydrocarbons and hydrocarbon ethers.

Halocarbon propellants useful in the present disclosure include fluorocarbon propellants in which all hydrogens are replaced with fluorine, chlorofluorocarbon propellants in which all hydrogens are replaced with chlorine and at least one fluorine, hydrogen-containing fluorocarbon propellants, and hydrogen-containing chlorofluorocarbon propellants. Halocarbon propellants are described in Johnson, U.S. Pat. No. 5,376,359; Byron et al., U.S. Pat. No. 5,190,029; and Purewal et al., U.S. Pat. No. 5,776,434. Hydrocarbon propellants useful in the disclosure include, for example, propane, isobutane, n-butane, pentane, isopentane and neopentane. A blend of hydrocarbons can also be used as a propellant. Ether propellants include, for example, dimethyl ether as well as the ethers. An aerosol formulation of the disclosure can also comprise more than one propellant. For example, the aerosol formulation can comprise more than one propellant from the same class, such as two or more fluorocarbons; or more than one, more than two, more than three propellants from different classes, such as a fluorohydrocarbon and a hydrocarbon. Pharmaceutical compositions of the present disclosure can also be dispensed with a compressed gas, e.g., an inert gas such as carbon dioxide, nitrous oxide or nitrogen.

Aerosol formulations can also include other components, for example, ethanol, isopropanol, propylene glycol, as well as surfactants or other components such as oils and detergents. These components can serve to stabilize the formulation and/or lubricate valve components.

The aerosol formulation can be packaged under pressure and can be formulated as an aerosol using solutions, suspensions, emulsions, powders and semisolid preparations. For example, a solution aerosol formulation can comprise a solution of an agent of the disclosure such as a developmental disorder associated biomarkers' inhibitors in (substantially) pure propellant or as a mixture of propellant and solvent. The solvent can be used to dissolve the agent and/or retard the evaporation of the propellant. Solvents useful in the disclosure include, for example, water, ethanol and glycols. Any combination of suitable solvents can be use, optionally combined with preservatives, antioxidants, and/or other aerosol components.

An aerosol formulation can also be a dispersion or suspension. A suspension aerosol formulation can comprise a suspension of an agent or combination of agents of the instant disclosure, e.g., a developmental disorder associated biomarkers' inhibitors, and a dispersing agent. Dispersing agents useful in the disclosure include, for example, sorbitan trioleate, oleyl alcohol, oleic acid, lecithin and corn oil. A suspension aerosol formulation can also include lubricants, preservatives, antioxidant, and/or other aerosol components.

An aerosol formulation can similarly be formulated as an emulsion. An emulsion aerosol formulation can include, for example, an alcohol such as ethanol, a surfactant, water and a propellant, as well as an agent or combination of agents of the disclosure, e.g., a developmental disorder associated biomarkers' inhibitors. The surfactant used can be nonionic, anionic or cationic. One example of an emulsion aerosol formulation comprises, for example, ethanol, surfactant, water and propellant. Another example of an emulsion aerosol formulation comprises, for example, vegetable oil, glyceryl monostearate and propane.

The compounds of the disclosure can be formulated for administration as suppositories. A low melting wax, such as a mixture of triglycerides, fatty acid glycerides, Witepsol S55 (trademark of Dynamite Nobel Chemical, Germany), or cocoa butter is first melted and the active component is dispersed homogeneously, for example, by stirring. The molten homogeneous mixture is then poured into convenient sized molds, allowed to cool, and to solidify.

The compounds of the disclosure can be formulated for vaginal administration. Pessaries, tampons, creams, gels, pastes, foams or sprays containing in addition to the active ingredient such carriers as are known in the art to be appropriate.

It is envisioned additionally, that the compounds of the disclosure can be attached releasably to biocompatible polymers for use in sustained release formulations on, in or attached to inserts for topical, intraocular, periocular, or systemic administration. The controlled release from a biocompatible polymer can be utilized with a water soluble polymer to form an instillable formulation, as well. The controlled release from a biocompatible polymer, such as for example, PLGA microspheres or nanospheres, can be utilized in a formulation suitable for intra ocular implantation or injection for sustained release administration, as well any suitable biodegradable and biocompatible polymer can be used.

In one aspect of the disclosure, the subject's carrier status of any of the genetic variation risk variants described herein, or genetic variants identified via other analysis methods within the genes or regulatory loci that are identified by the CNVs described herein, can be used to help determine whether a particular treatment modality for a developmental disorder, such as any one of the above, or a combination thereof, should be administered. The present disclosure also relates to methods of monitoring progress or effectiveness of a treatment option for a developmental disorder. The treatment option can include any of the above mentioned treatment options commonly used. This can be done based on the outcome of determination of the presence of a particular genetic variation risk variant in the individual, or by monitoring expression of genes that are associated with the variants of the present disclosure. Expression levels and/or mRNA levels can thus be determined before and during treatment to monitor its effectiveness. Alternatively, or concomitantly, the status with respect to a genetic variation, and or genotype and/or haplotype status of at least one risk variant for a developmental disorder presented herein can determined before and during treatment to monitor its effectiveness. It can also be appreciated by those skilled in the art that aberrant expression levels of a gene impacted by a CNV or other mutations found as a consequence of targeted sequencing of the CNV-identified gene can be assayed or diagnostically tested for by measuring the polypeptide expression level of said aberrantly expressed gene. In another embodiment, aberrant expression levels of a gene may result from a CNV impacting a DNA sequence (e.g., transcription factor binding site) that regulates a gene who's aberrant expression level is involved in or causes a developmental disorder, or other mutations found as a consequence of targeted sequencing of the CNV-identified gene regulatory sequence, can be assayed or diagnostically tested for by measuring the polypeptide expression level of the gene involved in or causative of a developmental disorder. In some embodiments, a specific CNV mutation within a gene, or other specific mutations found upon targeted sequencing of a CNV-identified gene found to be involved in or causative of a developmental disorder, may cause an aberrant structural change in the expressed polypeptide that results from said gene mutations and the altered polypeptide structure(s) can be assayed via various methods know to those skilled in the art.

Alternatively, biological networks or metabolic pathways related to the genes within, or associated with, the genetic variations described herein can be monitored by determining mRNA and/or polypeptide levels. This can be done for example, by monitoring expression levels of polypeptides for several genes belonging to the network and/or pathway in nucleic acid samples taken before and during treatment. Alternatively, metabolites belonging to the biological network or metabolic pathway can be determined before and during treatment. Effectiveness of the treatment is determined by comparing observed changes in expression levels/metabolite levels during treatment to corresponding data from healthy subjects.

In a further aspect, the genetic variations described herein and/or those subsequently found (e.g., via other genetic analysis methods such as sequencing) via targeted analysis of those genes initially identified by the genetic variations described herein, can be used to increase power and effectiveness of clinical trials. Thus, individuals who are carriers of at least one at-risk genetic variation can be more likely to respond to a particular treatment modality for a developmental disorder. In some embodiments, individuals who carry at-risk variants for gene(s) in a pathway and/or metabolic network for which a particular treatment is targeting are more likely to be responders to the treatment. In some embodiments, individuals who carry at-risk variants for a gene, which expression and/or function is altered by the at-risk variant, are more likely to be responders to a treatment modality targeting that gene, its expression or its gene product. This application can improve the safety of clinical trials, but can also enhance the chance that a clinical trial can demonstrate statistically significant efficacy, which can be limited to a certain sub-group of the population. Thus, one possible outcome of such a trial is that carriers of certain genetic variants are statistically significant and likely to show positive response to the therapeutic agent. Further, one or more of the genetic variations employed during clinical trials for a given therapeutic agent can be used in a companion diagnostic test that is administered to the patient prior to administration of the therapeutic agent to determine if the patient is likely to have favorable response to the therapeutic agent.

In a further aspect, the genetic variations described herein can be used for targeting the selection of pharmaceutical agents for specific individuals. The pharmaceutical agent can be any of the agents described in the above. Personalized selection of treatment modalities, lifestyle changes or combination of the two, can be realized by the utilization of the at-risk genetic variations or surrogate markers in linkage disequilibrium with the genetic variations. Thus, the knowledge of an individual's status for particular genetic variations can be useful for selection of treatment options, for example, for treatments that target genes or gene products affected by one or more of the genetic variations. Certain combinations of variants, including those described herein, but also combinations with other risk variants for a developmental disorder, can be suitable for one selection of treatment options, while other variant combinations can target other treatment options. Such combinations of variants can include one variant, two variants, three variants, or four or more variants, as needed to determine with clinically reliable accuracy the selection of treatment module.

Animal and Cell Models of Developmental Disorders

Also provided herein are engineered cells that can harbor one or more polymorphism described herein, for example, one or more genetic variations associated with a developmental disorder, for example a SNP or CNV. Such cells can be useful for studying the effect of a polymorphism on physiological function, and for identifying and/or evaluating potential therapeutic agents.

Methods are known in the art for generating cells, for example, by homologous recombination between the endogenous gene and an exogenous DNA molecule introduced into a cell, for example, a cell of an animal. In some cases, cells can be used to generate transgenic animals using methods known in the art.

The cells are preferably mammalian cells in which an endogenous gene has been altered to include a genetic variation as described herein. Techniques such as targeted homologous recombination, can be used to insert the heterologous DNA as described in, e.g., Chappel, U.S. Pat. No. 5,272,071; WO 91/06667. In another embodiment induced pluripotent stem cells with specific disease-causing or disease-associated mutations (such as CNVs and SNVs) can be used for disease modeling and drug discovery, for example, as described in Grskovic et al. (2011) Nat. Rev. Drug. Discov. 10(12):915-29.

Autism Spectrum Disorder is not known to occur naturally in any species other than humans, although animal models which show some features of the disease. This mouse model was created by replacing the normal mouse neurologin-3 gene with a mutated neuroligin-3 gene associated with autism in humans (Südhof, M. D., et al., UT Southwestern). By doing so, a gene was created in mice similar to the human autism disease gene. While the result amounted to a very small change in their genetic makeup, it mimics the same small change occurring in some patients with human autism. This and any other models described in the literature can be used with the methods of the disclosure.

Pharmaceutical compositions suitable for use in the present disclosure include compositions wherein the active ingredients are present in an effective amount, i.e., in an amount effective to achieve therapeutic and/or prophylactic benefit in a host with at least one a developmental disorder associated symptom. The actual amount effective for a particular application can depend on the condition or conditions being treated, the condition of the subject, the formulation, and the route of administration, as well as other factors known to those of skill in the art. Determination of an effective amount of a developmental disorder associated biomarkers' inhibitors is well within the capabilities of those skilled in the art, in light of the disclosure herein, and can be determined using routine optimization techniques.

The effective amount for use in humans can be determined from animal models. For example, a dose for humans can be formulated to achieve circulating, liver, topical and/or gastrointestinal concentrations that have been found to be effective in animals. One skilled in the art can determine the effective amount for human use, especially in light of the animal model experimental data described herein. Based on animal data, and other types of similar data, those skilled in the art can determine the effective amounts of compositions of the present disclosure appropriate for humans.

The effective amount when referring to an agent or combination of agents of the disclosure can generally mean the dose ranges, modes of administration, formulations, etc., that have been recommended or approved by any of the various regulatory or advisory organizations in the medical or pharmaceutical arts (e.g., FDA, AMA) or by the manufacturer or supplier.

Further, appropriate doses for a developmental disorder associated biomarkers' inhibitors can be determined based on in vitro experimental results. For example, the in vitro potency of an agent in inhibiting a developmental disorder associated biomarkers' components, provides information useful in the development of effective in vivo dosages to achieve similar biological effects. In some embodiments, administration of agents of the present disclosure can be intermittent, for example, administration once every two days, every three days, every five days, once a week, once or twice a month, and the like. In some embodiments, the amount, forms, and/or amounts of the different forms can be varied at different times of administration.

A person of skill in the art would be able to monitor in a subject the effect of administration of a particular agent. Other techniques would be apparent to one of skill in the art, wherein the active ingredients are present in an effective amount, for example, in an amount effective to achieve therapeutic and/or prophylactic benefit in a host with at least one a developmental disorder associated symptom. The actual amount effective for a particular application can depend on the condition or conditions being treated, the condition of the subject, the formulation, and the route of administration, as well as other factors known to those of skill in the art. Determination of an effective amount of a developmental disorder associated biomarkers' inhibitors is well within the capabilities of those skilled in the art, in light of the disclosure herein, and can be determined using routine optimization techniques.

Further, appropriate doses for a developmental disorder associated biomarkers' inhibitors can be determined based on in vitro experimental results. For example, the in vitro potency of an agent in inhibiting a developmental disorder associated biomarkers' components can provide information useful in the development of effective in vivo dosages to achieve similar biological effects.

Kits

Kits useful in the methods of the disclosure comprise components useful in any of the methods described herein, including for example, primers for nucleic acid amplification, hybridization probes for detecting genetic variation, or other marker detection, restriction enzymes, nucleic acid probes, optionally labeled with suitable labels, allele-specific oligonucleotides, antibodies that bind to an altered polypeptide encoded by a nucleic acid of the disclosure as described herein or to a wild type polypeptide encoded by a nucleic acid of the disclosure as described herein, means for amplification of genetic variations or fragments thereof, means for analyzing the nucleic acid sequence of nucleic acids comprising genetic variations as described herein, means for analyzing the amino acid sequence of a polypeptide encoded by a genetic variation, or a nucleic acid associated with a genetic variation, etc. The kits can for example, include necessary buffers, nucleic acid primers for amplifying nucleic acids, and reagents for allele-specific detection of the fragments amplified using such primers and necessary enzymes (e.g., DNA polymerase). Additionally, kits can provide reagents for assays to be used in combination with the methods of the present disclosure, for example, reagents for use with other screening assays for a developmental disorder.

In some embodiments, the disclosure pertains to a kit for assaying a nucleic acid sample from a subject to detect the presence of a genetic variation, wherein the kit comprises reagents necessary for selectively detecting at least one particular genetic variation in the genome of the individual. In some embodiments, the disclosure pertains to a kit for assaying a nucleic acid sample from a subject to detect the presence of at least particular allele of at least one polymorphism associated with a genetic variation in the genome of the subject. In some embodiments, the reagents comprise at least one contiguous oligonucleotide that hybridizes to a fragment of the genome of the individual comprising at least genetic variation. In some embodiments, the reagents comprise at least one pair of oligonucleotides that hybridize to opposite strands of a genomic segment obtained from a subject, wherein each oligonucleotide primer pair is designed to selectively amplify a fragment of the genome of the individual that includes at least one genetic variation, or a fragment of a genetic variation. Such oligonucleotides or nucleic acids can be designed using the methods described herein. In some embodiments, the kit comprises one or more labeled nucleic acids capable of allele-specific detection of one or more specific polymorphic markers or haplotypes with a genetic variation, and reagents for detection of the label. In some embodiments, a kit for detecting SNP markers can comprise a detection oligonucleotide probe, that hybridizes to a segment of template DNA containing a SNP polymorphisms to be detected, an enhancer oligonucleotide probe, detection probe, primer and/or an endonuclease, for example, as described by Kutyavin et al. (Nucleic Acid Res. 34:e128 (2006)).

In some embodiments, the DNA template is amplified by any means of the present disclosure, prior to assessment for the presence of specific genetic variations as described herein. Standard methods well known to the skilled person for performing these methods can be utilized, and are within scope of the disclosure. In one such embodiment, reagents for performing these methods can be included in the reagent kit.

In a further aspect of the present disclosure, a pharmaceutical pack (kit) is provided, the pack comprising a therapeutic agent and a set of instructions for administration of the therapeutic agent to humans screened for one or more variants of the present disclosure, as disclosed herein. The therapeutic agent can be a small molecule drug, an antibody, a peptide, an antisense or RNAi molecule, or other therapeutic molecules as described herein. In some embodiments, an individual identified as a carrier of at least one variant of the present disclosure is instructed to take a prescribed dose of the therapeutic agent. In one such embodiment, an individual identified as a carrier of at least one variant of the present disclosure is instructed to take a prescribed dose of the therapeutic agent. In some embodiments, an individual identified as a non-carrier of at least one variant of the present disclosure is instructed to take a prescribed dose of the therapeutic agent.

Also provided herein are articles of manufacture, comprising a probe that hybridizes with a region of human chromosome as described herein and can be used to detect a polymorphism described herein. For example, any of the probes for detecting polymorphisms described herein can be combined with packaging material to generate articles of manufacture or kits. The kit can include one or more other elements including: instructions for use; and other reagents such as a label or an agent useful for attaching a label to the probe. Instructions for use can include instructions for screening applications of the probe for making a diagnosis, prognosis, or theranosis to a developmental disorder in a method described herein. Other instructions can include instructions for attaching a label to the probe, instructions for performing in situ analysis with the probe, and/or instructions for obtaining a nucleic acid sample to be analyzed from a subject. In some cases, the kit can include a labeled probe that hybridizes to a region of human chromosome as described herein.

The kit can also include one or more additional reference or control probes that hybridize to the same chromosome or another chromosome or portion thereof that can have an abnormality associated with a particular endophenotype. A kit that includes additional probes can further include labels, e.g., one or more of the same or different labels for the probes. In other embodiments, the additional probe or probes provided with the kit can be a labeled probe or probes. When the kit further includes one or more additional probe or probes, the kit can further provide instructions for the use of the additional probe or probes. Kits for use in self-testing can also be provided. Such test kits can include devices and instructions that a subject can use to obtain a nucleic acid sample (e.g., buccal cells, blood) without the aid of a health care provider. For example, buccal cells can be obtained using a buccal swab or brush, or using mouthwash.

Kits as provided herein can also include a mailer (e.g., a postage paid envelope or mailing pack) that can be used to return the nucleic acid sample for analysis, e.g., to a laboratory. The kit can include one or more containers for the nucleic acid sample, or the nucleic acid sample can be in a standard blood collection vial. The kit can also include one or more of an informed consent form, a test requisition form, and instructions on how to use the kit in a method described herein. Methods for using such kits are also included herein. One or more of the forms (e.g., the test requisition form) and the container holding the nucleic acid sample can be coded, for example, with a bar code for identifying the subject who provided the nucleic acid sample.

In some embodiments, an in vitro screening test can comprise one or more devices, tools, and equipment configured to collect a nucleic acid sample from an individual. In some embodiments of an in vitro screening test, tools to collect a nucleic acid sample can include one or more of a swab, a scalpel, a syringe, a scraper, a container, and other devices and reagents designed to facilitate the collection, storage, and transport of a nucleic acid sample. In some embodiments, an in vitro screening test can include reagents or solutions for collecting, stabilizing, storing, and processing a nucleic acid sample.

Such reagents and solutions for nucleotide collecting, stabilizing, storing, and processing are well known by those of skill in the art and can be indicated by specific methods used by an in vitro screening test as described herein. In some embodiments, an in vitro screening test as disclosed herein, can comprise a microarray apparatus and reagents, a flow cell apparatus and reagents, a multiplex nucleotide sequencer and reagents, and additional hardware and software necessary to assay a nucleic acid sample for certain genetic markers and to detect and visualize certain genetic markers.

The present disclosure further relates to kits for using antibodies in the methods described herein. This includes, but is not limited to, kits for detecting the presence of a variant polypeptide in a test nucleic acid sample. One preferred embodiment comprises antibodies such as a labeled or labelable antibody and a compound or agent for detecting variant polypeptides in a nucleic acid sample, means for determining the amount or the presence and/or absence of variant polypeptide in the nucleic acid sample, and means for comparing the amount of variant polypeptide in the nucleic acid sample with a standard, as well as instructions for use of the kit. In certain embodiments, the kit further comprises a set of instructions for using the reagents comprising the kit.

Unless otherwise explained, all technical and scientific terms used herein have the same meaning as commonly understood by one of ordinary skill in the art to which this disclosure belongs. The following references contain embodiments of the methods and compositions that can be used herein: The Merck Manual of Diagnosis and Therapy, 18th Edition, published by Merck Research Laboratories, 2006 (ISBN 0-911910-18-2); Benjamin Lewin, Genes IX, published by Jones & Bartlett Publishing, 2007 (ISBN-13: 9780763740634); Kendrew et al. (eds.), The Encyclopedia of Molecular Biology, published by Blackwell Science Ltd., 1994 (ISBN 0-632-02182-9); and Robert A. Meyers (ed.), Molecular Biology and Biotechnology: a Comprehensive Desk Reference, published by VCH Publishers, Inc., 1995 (ISBN 1-56081-569-8).

Standard procedures of the present disclosure are described, e.g., in Maniatis et al., Molecular Cloning: A Laboratory Manual, Cold Spring Harbor Laboratory Press, Cold Spring Harbor, N.Y., USA (1982); Sambrook et al., Molecular Cloning: A Laboratory Manual (2 ed.), Cold Spring Harbor Laboratory Press, Cold Spring Harbor, N.Y., USA (1989); Davis et al., Basic Methods in Molecular Biology, Elsevier Science Publishing, Inc., New York, USA (1986); or Methods in Enzymology: Guide to Molecular Cloning Techniques Vol. 152, S. L. Berger and A. R. Kimmerl (eds.), Academic Press Inc., San Diego, USA (1987)). Current Protocols in Molecular Biology (CPMB) (Fred M. Ausubel, et al. ed., John Wiley and Sons, Inc.), Current Protocols in Protein Science (CPPS) (John E. Coligan, et. al., ed., John Wiley and Sons, Inc.), Current Protocols in Immunology (CPI) (John E. Coligan, et. al., ed. John Wiley and Sons, Inc.), Current Protocols in Cell Biology (CPCB) (Juan S. Bonifacino et. al. ed., John Wiley and Sons, Inc.), Culture of Animal Cells: A Manual of Basic Technique by R. Ian Freshney, Publisher: Wiley-Liss; 5th edition (2005), and Animal Cell Culture Methods (Methods in Cell Biology, Vol. 57, Jennie P. Mather and David Barnes editors, Academic Press, 1st edition, 1998), which are all incorporated by reference herein in their entireties.

It should be understood that the following examples should not be construed as being limiting to the particular methodology, protocols, and compositions, etc., described herein and, as such, can vary. The following terms used herein is for the purpose of describing particular embodiments only, and is not intended to limit the scope of the embodiments disclosed herein.

Disclosed herein are molecules, materials, compositions, and components that can be used for, can be used in conjunction with, can be used in preparation for, or are products of methods and compositions disclosed herein. It is understood that when combinations, subsets, interactions, groups, etc. of these materials are disclosed and while specific reference of each various individual and collective combinations and permutation of these molecules and compounds cannot be explicitly disclosed, each is specifically contemplated and described herein. For example, if a nucleotide or nucleic acid is disclosed and discussed and a number of modifications that can be made to a number of molecules including the nucleotide or nucleic acid are discussed, each and every combination and permutation of nucleotide or nucleic acid and the modifications that are possible are specifically contemplated unless specifically indicated to the contrary. This concept applies to all aspects of this application including, but not limited to, steps in methods of making and using the disclosed molecules and compositions. Thus, if there are a variety of additional steps that can be performed it is understood that each of these additional steps can be performed with any specific embodiment or combination of embodiments of the disclosed methods, and that each such combination is specifically contemplated and should be considered disclosed.

Those skilled in the art can recognize, or be able to ascertain using no more than routine experimentation, many equivalents to the specific embodiments of the method and compositions described herein. Such equivalents are intended to be encompassed by the following claims.

It is understood that the disclosed methods and compositions are not limited to the particular methodology, protocols, and reagents described as these can vary. It is also to be understood that the terminology used herein is for the purpose of describing particular embodiments only, and is not intended to limit the scope of the present disclosure which can be limited only by the appended claims.

Unless defined otherwise, all technical and scientific terms used herein have the meanings that would be commonly understood by one of skill in the art in the context of the present specification.

It should be noted that as used herein and in the appended claims, the singular forms "a," "an," and "the" include plural reference unless the context clearly dictates otherwise. Thus, for example, reference to "a nucleotide" includes a plurality of such nucleotides; reference to "the nucleotide" is a reference to one or more nucleotides and equivalents thereof known to those skilled in the art, and so forth.

The term "and/or" shall in the present context be understood to indicate that either or both of the items connected by it are involved. While preferred embodiments of the present disclosure have been shown and described herein, it can be obvious to those skilled in the art that such embodiments are provided by way of example only. Numerous variations, changes, and substitutions can now occur to those skilled in the art without departing from the disclosure. It should be understood that various alternatives to the embodiments of the disclosure described herein can be employed in practicing the disclosure. It is intended that the following claims define the scope of the disclosure and that methods and structures within the scope of these claims and their equivalents be covered thereby.

EXAMPLES

Example 1

In the present study, the Agilent 1M CGH array was used to detect novel, rare CNVs in a total of 1687 individuals in 2 cohorts:
1. 1,005 Normal individuals (Normal Variation Engine—NVE);
2. 682 ASD cases (ASD).

The Normal DNA samples were from apparently healthy Caucasian donors >45 years old. Health history information was documented at the time of consent via a questionnaire filled out by the donor. This information was used to select 1,000 Normals based on the following attributes: BMI between 15-35, blood glucose level <125 mg/dL, total cholesterol level between 100-300, systolic blood pressure between 100-150, and no major neurodegenerative diseases or psychiatric disorders (alcoholism, mental illness, depression, dementia, Alzheimer's disease, and Parkinson's disease).

For the ASD samples, Reference DNA samples were labeled with Cy3 and test subject cases with Cy5. After labeling, samples were combined and co-hybridized to Agilent 1M feature oligonucleotide microarrays, design ID 021529 (Agilent Product Number G4447A) using standard conditions (array Comparative Genomic Hybridization—aCGH). Post-hybridization, arrays were scanned at 3 μm resolution, using Agilent's DNA microarray scanner, generating tiff images for later analysis. All hybridizations were sex-matched; reference samples were pools of 50 male and 50 female samples, respectively. Genomic DNA for the reference pools was isolated from cell lines.

Genomic DNA samples from individuals within the Normal cohort ('test' subjects) were hybridized against a single, sex-matched reference individual as follows. Reference DNA samples were labeled with Cy5 and Test subject DNA samples were labeled with Cy3. After labeling, samples were combined and co-hybridized to Agilent 1M feature oligonucleotide microarrays, design ID 021529 (Agilent Product Number G4447A) using standard conditions (array Comparative Genomic Hybridization—aCGH). Post-hybridization, arrays were scanned at 2 μm resolution, using Agilent's DNA microarray scanner, generating tiff images for later analysis.

All tiff images were analyzed using Agilent Feature Extraction (FE) software, with the following settings:
Human Genome Freeze:hg18:NCBI36:Mar2006
FE version: 10.7.3.1
Grid/design file: 021529_D_F_20091001
Protocol: CGH_107_Sep09

This procedure generated a variety of output files, one of which was a text-tab delimited file, containing ~1,000,000 rows of data, each corresponding to a specific feature on the array. This *.txt file was used to perform CNV calling using DNAcopy, an open source software package implemented in R via BioConductor. Losses or gains were determined according to a threshold log 2 ratio, which was set at −/+0.35. In other words, all losses with a log 2 ratio value ≤−0.35 were counted, as were all gains with a log 2 ratio≥+0.35. Log 2 ratio values were determined according to Cy3/Cy5 (Test/Reference). The minimum probe number to call a CNV was set at 2 (2 consecutive probes were sufficient to call a CNV). A CNV list was thus generated for each individual in the 2 cohorts.

There were a total of 162,316 CNVs in the NVE cohort of 1,005 individuals. Using custom scripts, these CNVs (many of which appeared in multiple individuals) were 'merged' into a master list (NVE-master) of non-redundant CNV-subregions, according to the presence or absence of the CNV-subregion in individuals within the cohort. Using this approach, the NVE-master list has 14,693 distinct CNV-subregions, some of which are uniquely present in a single individual and some of which are present in multiple individuals. For example, consider 3 individuals within the NVE cohort with the following hypothetical CNVs:

Chr1:1-100,000;
Chr1:10,001-100,000;
Chr1:1-89,999;

In the master list, these would be merged into 3 distinct CNV subregions, as follows:

| CNV-subregion 1 | Chr1:1-10,000 | Patients A, C |
| CNV-subregion 2 | Chr1:10,001-89,999 | Patients A, B, C |
| CNV-subregion 3 | Chr 90,000:1-100,000 | Patients A, B |

There were a total of 72,183 CNVs in the ASD cohort of 682 individuals. Using custom scripts, these CNVs (many of which appeared in multiple individuals) were 'merged' into a master list (ASD-master) of non-redundant CNV-subregions, according to the presence or absence of the CNV-subregion in individuals within the cohort. Using this approach, the ASD-master list has 13,914 distinct CNV-subregions, some of which are uniquely present in a single individual and some of which are present in multiple individuals.

CNV-subregions of interest were obtained after:
1. Annotation using custom designed scripts in order to attach to each CNV region relevant information regarding overlap with known genes, exons and CNVs generated by a study from the Sanger institute (www.sanger.ac.uk/research/areas/humangenetics/cnv/highresdiscovery)
2. A calculation of the odds ratio (OR) for each CNV-subregion.

The OR for each subregion was calculated according to the following formula:

OR=(ASD/(682−ASD))/(NVE/(1005−NVE))

where: ASD=number of ASD individuals with CNV-subregion of interest, and NVE=number of NVE individuals with CNV-subregion of interest As an illustrative example, consider the CNV subregion chr1: 750052-770858 (first row of Table 2), which is found in 1 individual in the NVE cohort and 6 individuals in the ASD cohort.

The OR calculated was (6/(682−6))/(1/(1005−1))=8.91.

By convention, if NVE=0, it is set to 1, in order to avoid dealing with infinities. This has the effect of artificially lowering OR values in cases where none are seen in the NVE. When calculating OR values for identical CNV-subregions, gains and losses are combined.

CNV-subregions/genes that fulfill one of the following criteria were determined:
1. Genic (distinct CNV-subregions); OR>6
2. Exon+ve, ASD>4, NVE<2, no Sanger filter applied
3. Exon+ve, 5>ASD>1, Normals<2, Sanger filter−ve
4. Intron+ve, ASD>4, Normals<2, no Sanger filter applied
5. MTRNR2L family
6. High OR intergenic (OR>30)

The number of ASD candidate CNV-subregions, irrespective of category (genic or non-genic), may increase or decrease as additional ASD cohorts are analyzed A variety of CNVs may cause a pathogenic effect in affected patients that have at least one CNV from one of these categories. For example, CNVs can be non-overlapping (distinct CNVs) but all impact the same gene (category 1). In other patients with a neurodevelopment disorder, the CNVs may be overlapping and/or non-overlapping, impact an exon, and they affect 5 or more cases but only 0 or 1 Normal subjects and no filter of Sanger CNVs is applied due to the relatively high OR value (>7) for this category. In category 3, the CNVs may be overlapping and/or non-overlapping, impact an exon, and they affect <5 cases but only 0 or 1 Normal subjects and no Sanger CNVs overlap, which enables identification of rarer CNVs in cases with a neurodevelopmental disorder but with the stringency of Sanger CNVs that are presumed to be relatively common in the general population. Category 4 is equivalent to category 2 except that the CNVs impact an intron as it is appreciated by those skilled in the art that genetic variants (such as CNVs) impacting introns can be pathogenic (e.g., such variants can result in alternatively spliced mRNAs or loss of a microRNA binding site, which may deleteriously impact the resulting protein's structure or expression level). Category 5 corresponds to CNVs that impact the MTRNR2L gene family, which are also known as humanins (Matsuoka M, et al. Humanin and the receptors for humanin. Mol Neurobiol. 2010 February; 41(1):22-8; Bodzioch M, et al. Evidence for potential functionality of nuclearly-encoded humanin isoforms. Genomics. 2009 October; 94(4):247-56; Maftei M, et al. Interaction structure of the complex between neuroprotective factor humanin and Alzheimer's β-amyloid peptide revealed by affinity mass spectrometry and molecular modeling. J Pept Sci. 2012 June; 18(6):373-82; Arakawa T, et al. Advances in characterization of neuroprotective peptide, humanin. Curr Med Chem. 2011; 18(36):5554-63; Zapala B, et al. Humanins, the neuroprotective and cytoprotective peptides with antiapoptotic and anti-inflammatory properties. Pharmacol Rep. 2010 September-October; 62(5):767-77.

While humanins may have neuroprotective properties for Alzheimer's disease, it is not established in neurodevelopment disorders; however, recently links have been established between the Alzheimer's gene APP and neurodevelopmental disorders such as autism (Westmark C J. What's hAPPening at synapses? The role of amyloid β-protein precursor and β-amyloid in neurological disorders. Mol Psychiatry. 2012 Aug. 28). Category 6 CNVs are those that occur within intergenic regions but with high OR (>30) as it is well known by those skilled in the art that gene regulatory regions often reside in adjacent regions of genes such as have been experimentally determined and annotated in the ENCODE project (ENCODE Project Consortium, Bernstein B E, et al. An integrated encyclopedia of DNA elements in the human genome. Nature. 2012 Sep. 6; 489(7414):57-74).

Example 2

Some pathway analysis software will be used to identify whether the candidate gene will be a drug target, which may be FDA-approved or in clinical trials. Such information will assist in the design of clinical trials (e.g., patient stratification for genetic subtypes) or will be used to facilitate clinical trials that are in progress, thereby reducing the attrition rate (failure to receive FDA approval) and reducing the time and cost of drug development. When a candidate ASD gene is identified as a known drug target of an FDA-approved therapeutic, the drug can be repurposed and approved for use in a new indication (e.g., a cancer or anti-inflammatory agent may be beneficial to ASD patients as well). Those skilled in the art will recognize that Phase II and III failures may be rescued with additional clinical trial data that accounts for genetic subtypes, particularly when the drug fails for lack of efficacy. For example, if a drug will be designed or established to target a particular gene defect (e.g., use of an RNAi therapeutic to decrease aberrant overexpression of the gene that is caused by a CNV or other type of genetic variant), it will be expected that only ASD patients with that particular genetic subtype will benefit from the targeted therapy.

Example 3

FIG. 1 represents an example of group 1 (Genic (distinct CNV-subregions); OR>6). There are 10 ASD cases and 0 NVE subjects affected by non-overlapping and overlapping CNV-subregions. The CNV are gains (log 2 ratio>0.35) or losses (log 2 ratio<−0.35) and affect the gene NRG1 on chromosome 8. The calculated odds ratio (OR) for this CNV-subregion is 14.94.

In the figure, three tracks of information are shown, from top to bottom: 1) RefSeq gene annotation showing the genome location (x-axis) of genes demarcated in light gray (introns) and dark gray (exons) and with multiple entries depicted if multiple transcript variants are annotated that correspond to the gene; 2) size and genome location (x-axis) for normal CNVs annotated for greater than 1,000 unaffected/normal individuals, with CNVs demarcated by dark gray bars and the y-axis corresponds to the number of individuals in the normal cohort found to have the CNV; 3) array CGH data (black dots correspond to the probes on the microarray) for an ASD case with a CNV wherein the y-axis is the log 2 ratio value of the test (ASD case) and reference (healthy control) genomic DNAs and the x-axis corresponds to the genome location of the probes and CNVs, which are depicted as line segments shifted positively (copy number gain) or negatively (copy number loss) relative to the baseline (log 2 ratio=0).

Example 4

Figure 2:
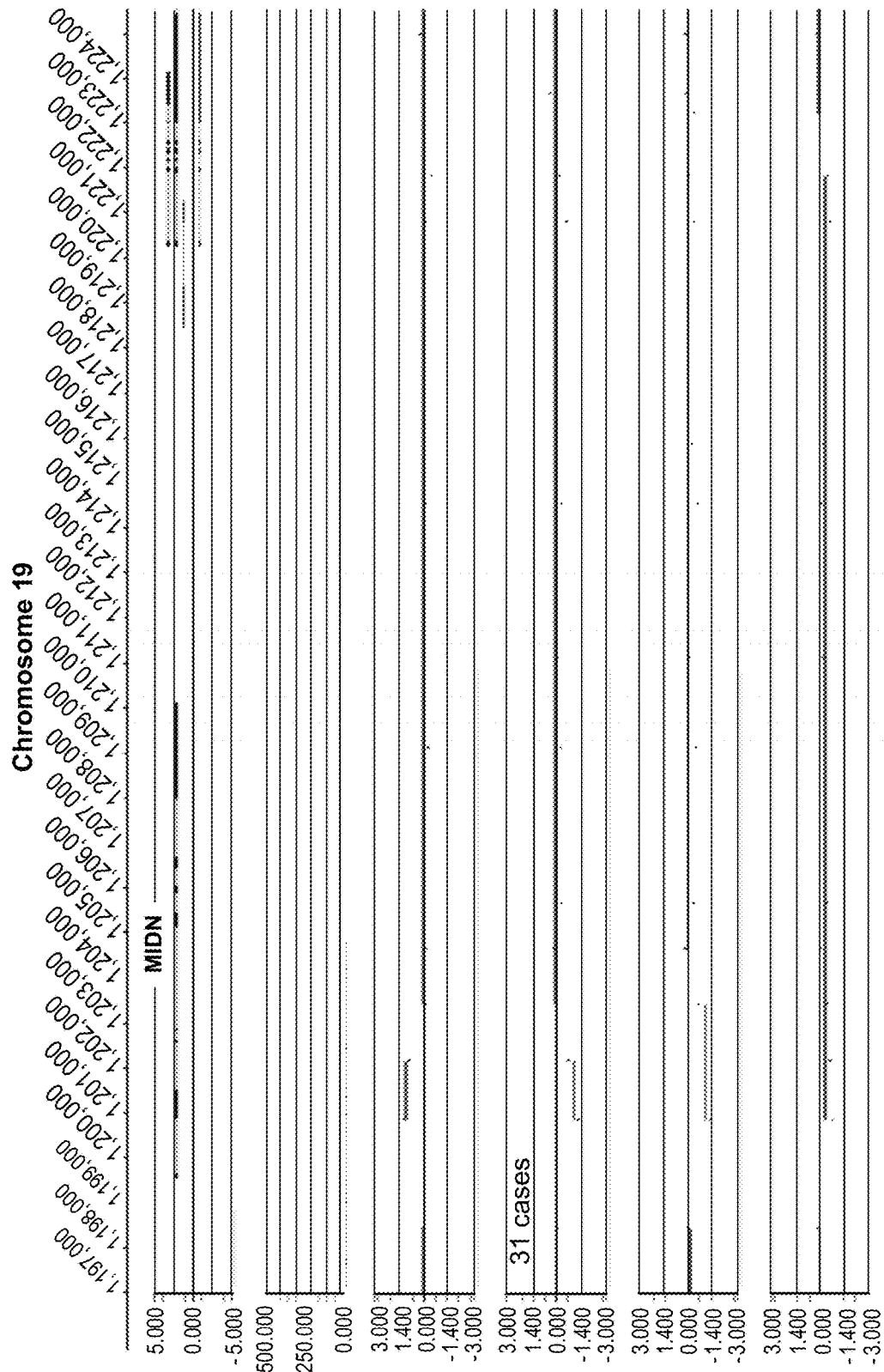
FIG. 2 represents an example of group 2 (Exon+ve, ASD>4, Normals<2, no Sanger filter applied). There are 34 ASD cases in total (including 31 with an identical sized loss) and 1 NVE subject affected by overlapping CNV-subregions that impact an exon. The CNV are a gain (log 2 ratio>0.35) or losses (log 2 ratio<−0.35) and affect the gene MIDN on chromosome 19. The calculated odds ratio (OR) for this CNV-subregion is 52.68.

FIG. 2 represents an example of group 2 (Exon+ve, ASD>4, Normals<2, no Sanger filter applied). There are 34 ASD cases in total (31 with an identical loss) and 1 NVE subject affected by overlapping CNV-subregions that impact an exon. The CNV are a gain (log 2 ratio>0.35) or losses (log 2 ratio<−0.35) and affect the gene MIDN on chromosome 19. The calculated odds ratio (OR) for this CNV-subregion is 52.68.

In the figure, three tracks of information are shown, from top to bottom: 1) RefSeq gene annotation showing the genome location (x-axis) of genes demarcated in light gray (introns) and dark gray (exons) and with multiple entries depicted if multiple transcript variants are annotated that correspond to the gene; 2) size and genome location (x-axis) for normal CNVs annotated for greater than 1,000 unaffected/normal indivduals, with CNVs demarcated by dark gray bars and the y-axis corresponds to the number of individuals in the normal cohort found to have the CNV; 3) array CGH data (black dots correspond to the probes on the microarray) for an ASD case with a CNV wherein the y-axis is the log 2 ratio value of the test (ASD case) and reference (healthy control) genomic DNAs and the x-axis corresponds to the genome location of the probes and CNVs, which are depicted as line segments shifted positively (copy number gain) or negatively (copy number loss) relative to the baseline (log 2 ratio=0).

Example 5

Figure 3:
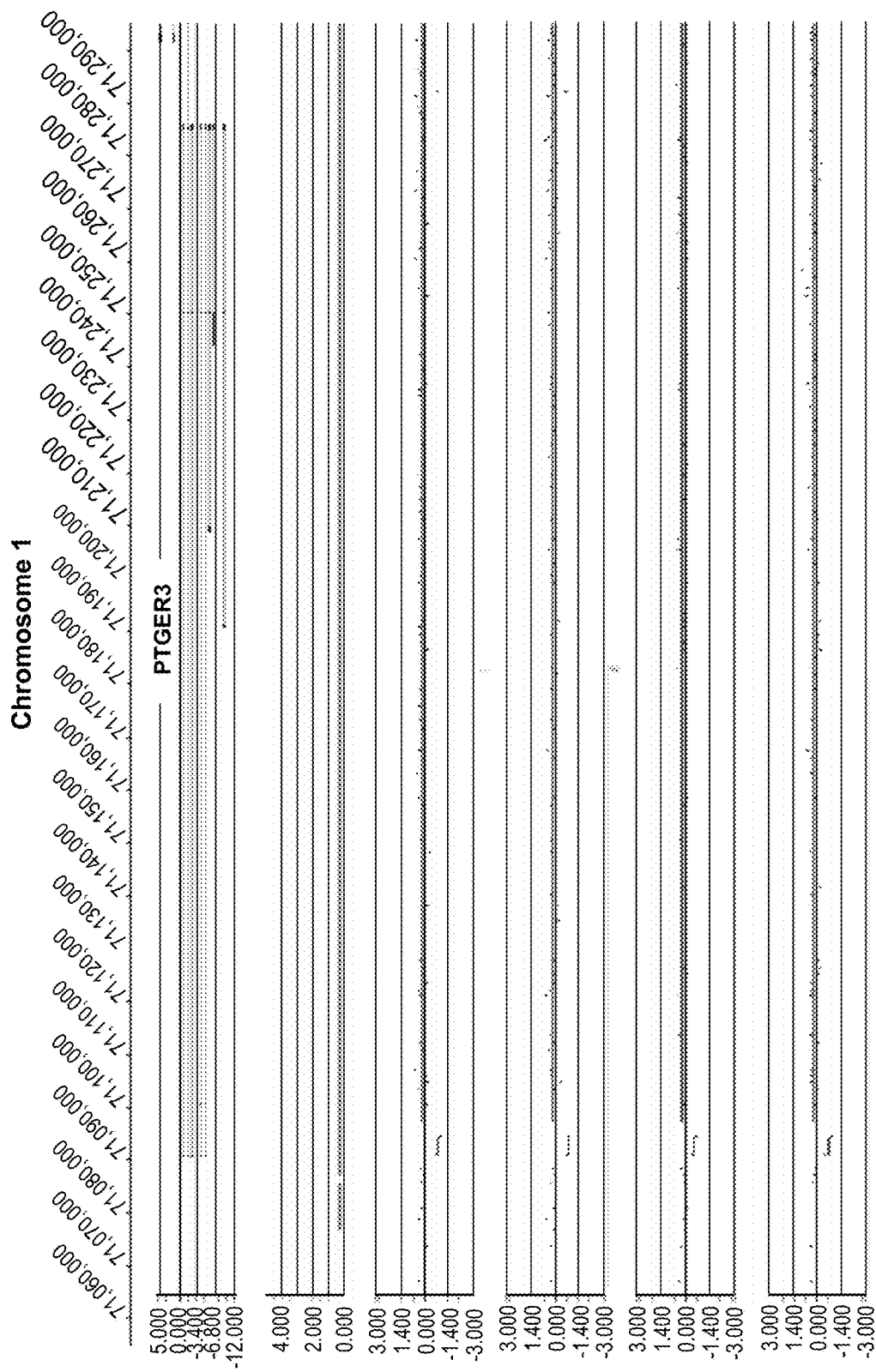
FIG. 3 represents an example of group 3 (Exon+ve, 5>ASD>1, Normals<2, Sanger−ve). There are 4 ASD cases in total and 1 NVE subject affected by an overlapping CNV-subregion that impacts an exon. The CNV are losses (log 2 ratio<−0.35) and affect the gene PTGER3 on chromosome 1 and no Sanger CNVs overlap this CNV (Sanger−ve). The calculated odds ratio (OR) for this CNV-subregion is 5.92.

FIG. 3 represents an example of group 3 (Exon+ve, 5>ASD>1, Normals<2, Sanger−ve). There are 4 ASD cases in total and 1 NVE subject affected by an overlapping CNV-subregion that impacts an exon. The CNV are losses (log 2 ratio<−0.35) and affect the gene PTGER3 on chromosome 1 and no Sanger CNVs overlap this CNV (Sanger−ve). The calculated odds ratio (OR) for this CNV-subregion is 5.92.

In the figure, three tracks of information are shown, from top to bottom: 1) RefSeq gene annotation showing the genome location (x-axis) of genes demarcated in light gray (introns) and dark gray (exons) and with multiple entries depicted if multiple transcript variants are annotated that correspond to the gene; 2) size and genome location (x-axis) for normal CNVs annotated for greater than 1,000 unaffected/normal indivduals, with CNVs demarcated by dark gray bars and the y-axis corresponds to the number of individuals in the normal cohort found to have the CNV; 3) array CGH data (black dots correspond to the probes on the microarray) for an ASD case with a CNV wherein the y-axis is the log 2 ratio value of the test (ASD case) and reference (healthy control) genomic DNAs and the x-axis corresponds to the genome location of the probes and CNVs, which are depicted as line segments shifted positively (copy number gain) or negatively (copy number loss) relative to the baseline (log 2 ratio=0).

Example 6

Figure 4:
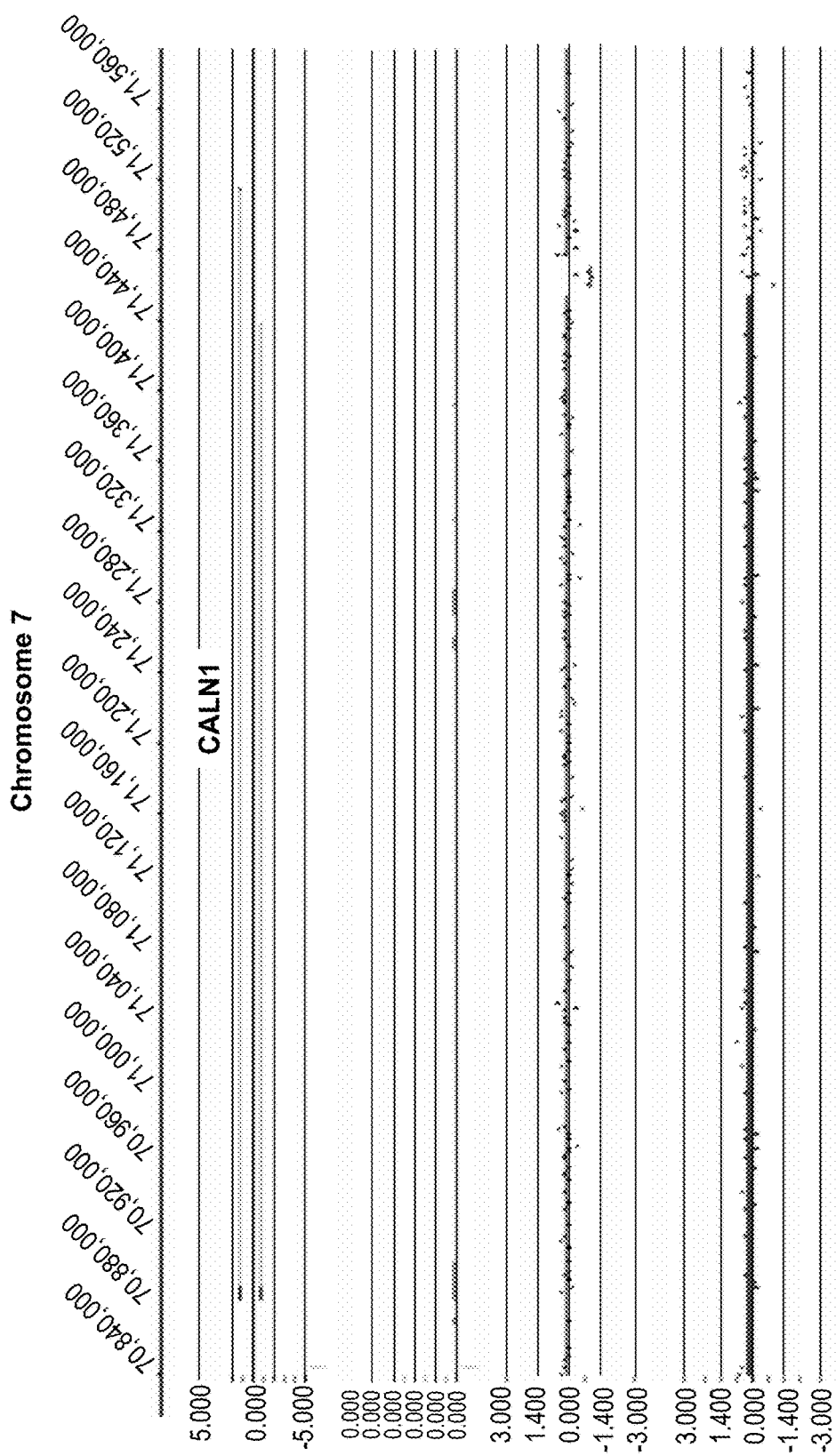
FIG. 4 represents an example of group 4 (Intron+ve, ASD>4, Normals<2, no Sanger filter applied). There are 8 ASD cases in total (3 cases impact an identical CNV loss) and 0 NVE subjects affected by an overlapping CNV-subregion that impacts an intron. The CNV are losses (log 2 ratio<−0.35) or a gain (log 2 ratio>0.35) and affect the gene CALN1 on chromosome 7. The calculated odds ratio (OR) for this CNV-subregion is 11.92.
Figure 4:
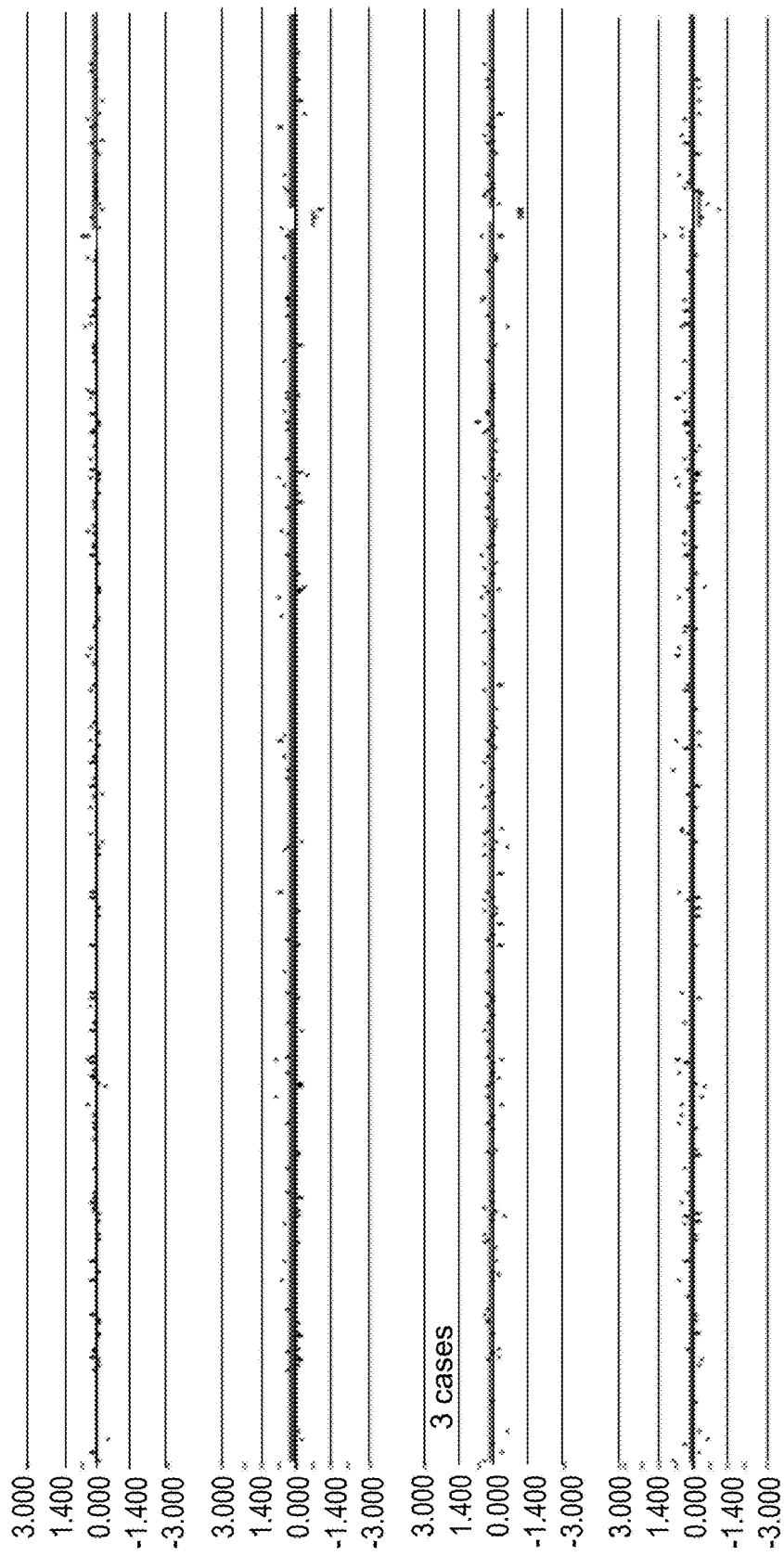

FIG. 4 represents an example of group 4 (Intron+ve, ASD>4, Normals<2, no Sanger filter applied). There are 8 ASD cases in total (3 cases impact an identical CNV loss) and 0 NVE subjects affected by an overlapping CNV-subregion that impacts an intron. The CNV are losses (log 2 ratio<−0.35) or a gain (log 2 ratio>0.35) and affect the gene CALN1 on chromosome 7. The calculated odds ratio (OR) for this CNV-subregion is 11.92.

In the figure, three tracks of information are shown, from top to bottom: 1) RefSeq gene annotation showing the genome location (x-axis) of genes demarcated in light gray (introns) and dark gray (exons) and with multiple entries depicted if multiple transcript variants are annotated that correspond to the gene; 2) size and genome location (x-axis) for normal CNVs annotated for greater than 1,000 unaffected/normal indivduals, with CNVs demarcated by dark gray bars and the y-axis corresponds to the number of individuals in the normal cohort found to have the CNV; 3) array CGH data (black dots correspond to the probes on the microarray) for an ASD case with a CNV wherein the y-axis is the log 2 ratio value of the test (ASD case) and reference (healthy control) genomic DNAs and the x-axis corresponds to the genome location of the probes and CNVs, which are depicted as line segments shifted positively (copy number gain) or negatively (copy number loss) relative to the baseline (log 2 ratio=0).

Example 7

Figure 5:
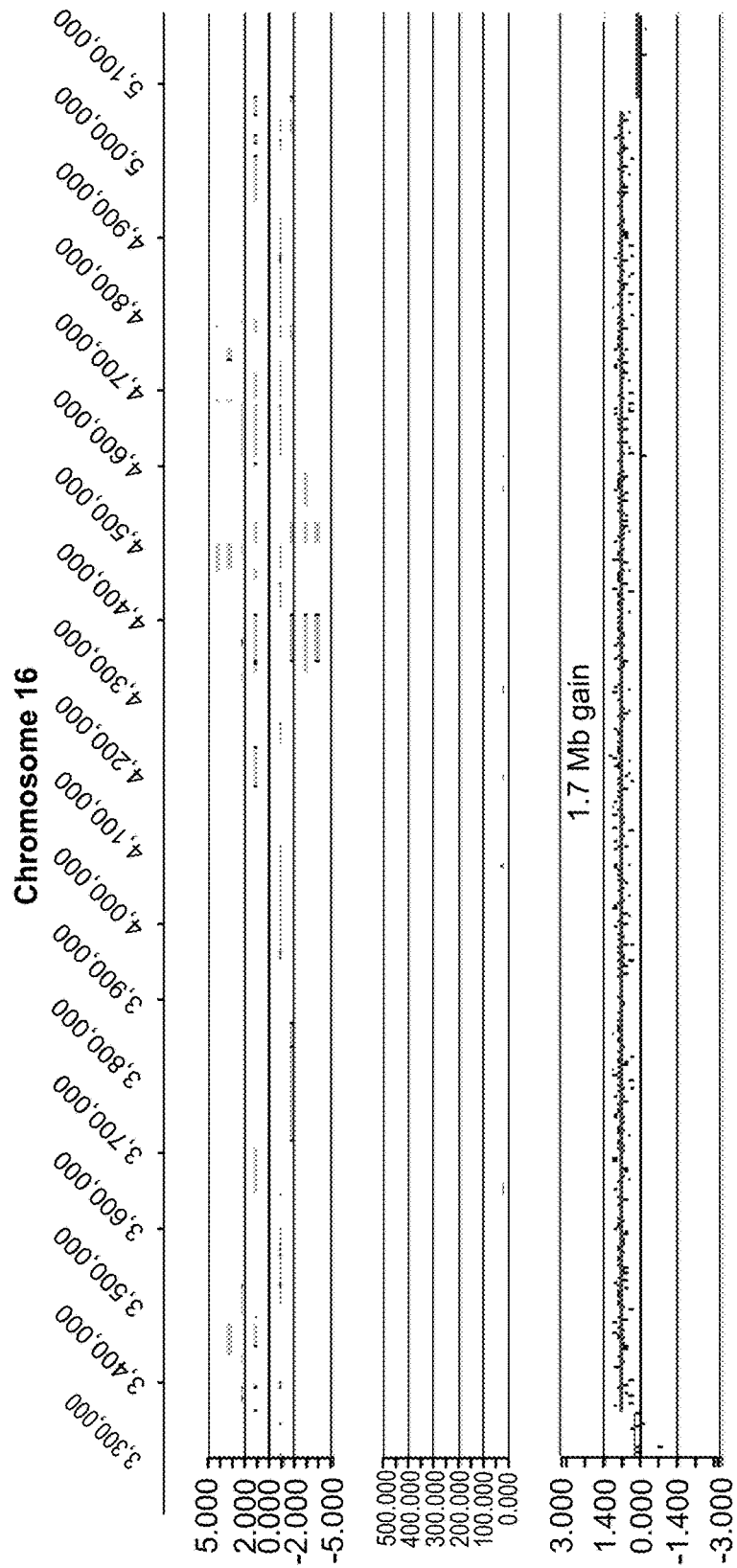
FIG. 5 represents an example of group 5 (MTRNR2L_family). There is 1 ASD case and 0 NVE subjects that impacts an exon of an MTRNR2L gene family member. The CNV gain (log 2 ratio>0.35) is 1.7 Mb in size and its left breakpoint disrupts MTRNR2L4 and its right breakpoint disrupts ALG1 on chromosome 16. The calculated odds ratio (OR) for this CNV-subregion is 1.47.
Figure 5:
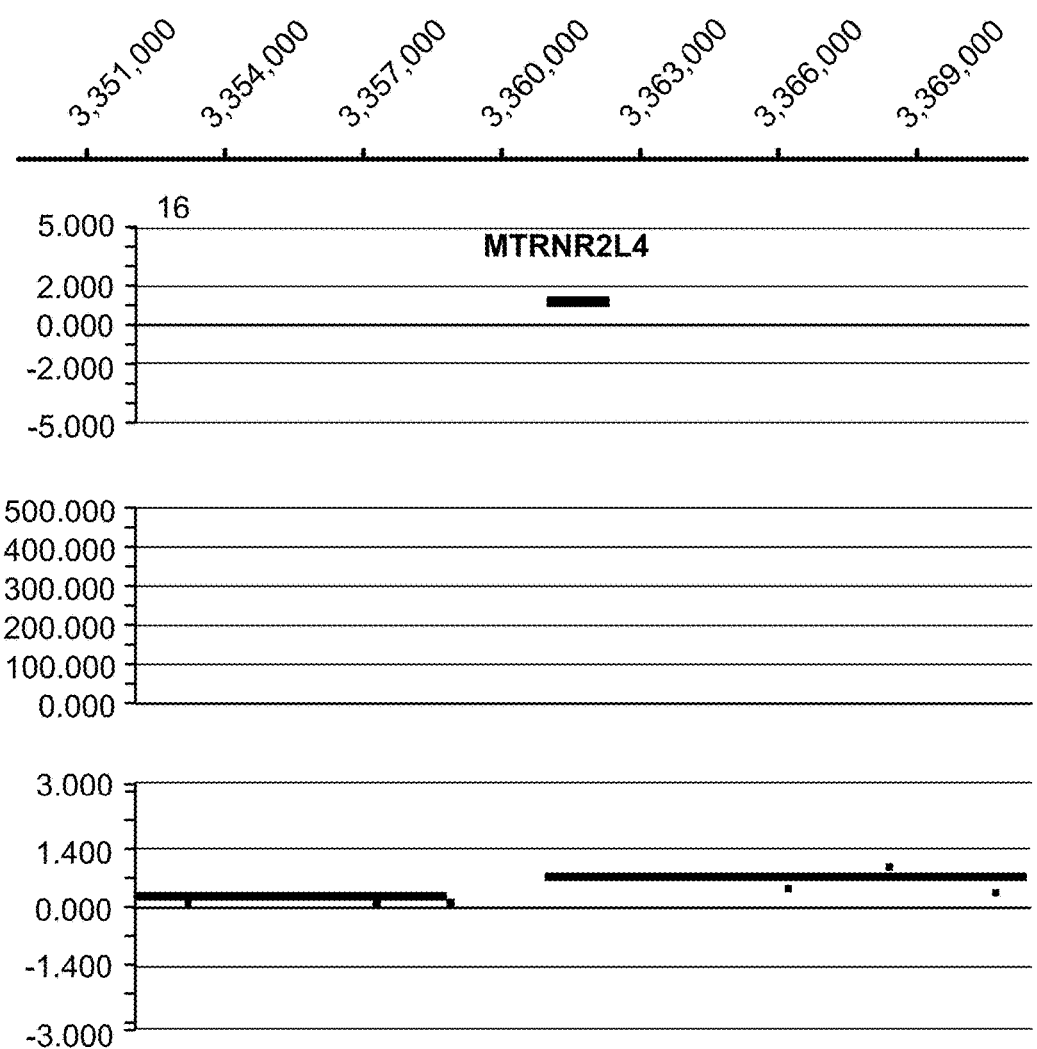
Figure 5:
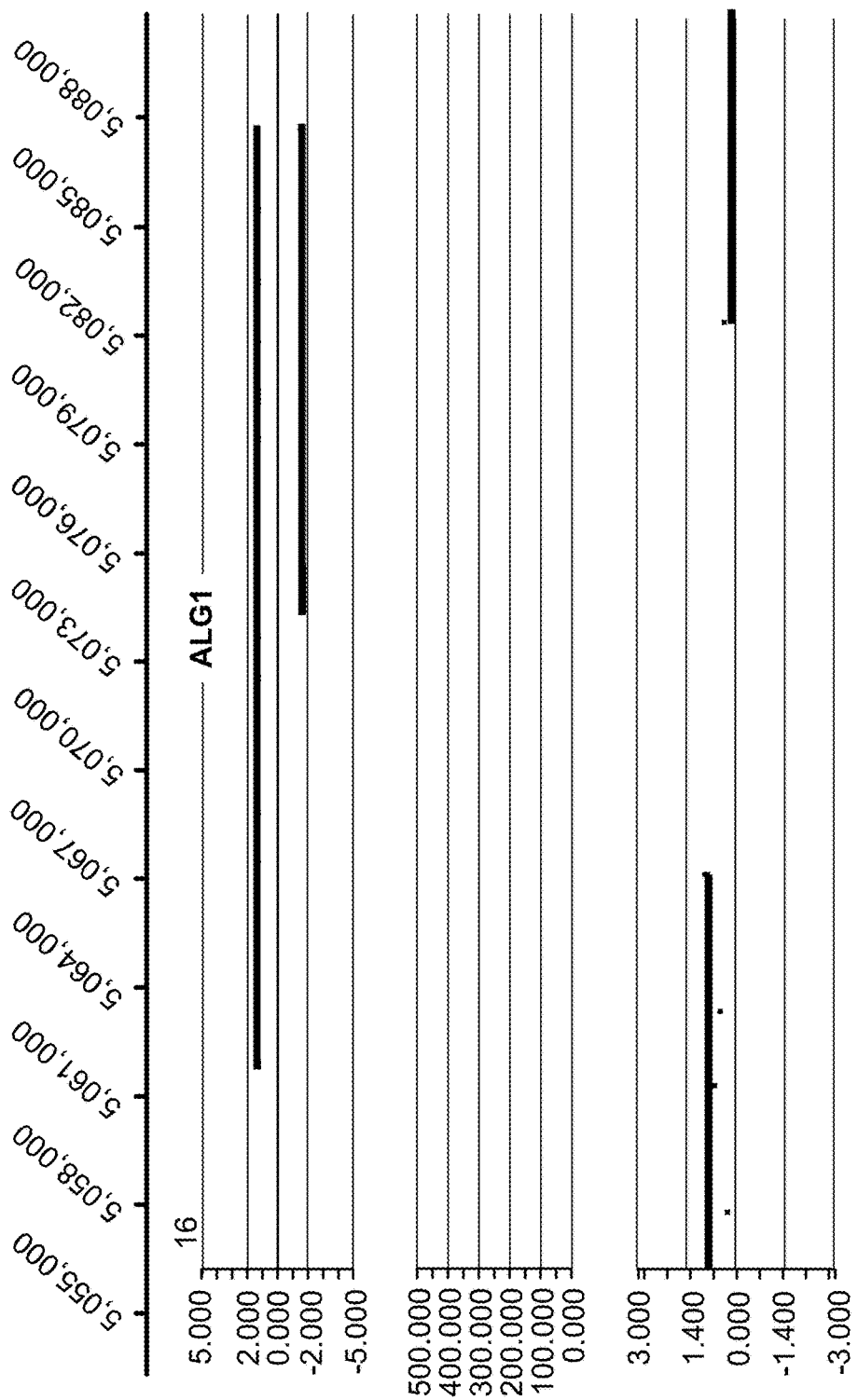

FIG. 5 represents an example of group 5 (MTRNR2L_family). There is 1 ASD case and 0 NVE subjects that impact an exon of an MTRNR2L gene family member. The CNV gain (log 2 ratio>0.35) is 1.7 Mb in size and its left breakpoint disrupts MTRNR2L4 and its right breakpoint disrupts ALG1 on chromosome 16. The calculated odds ratio (OR) for this CNV-subregion is 1.47.

The top panel shows the complete CNV, which impacts several genes. The lower left panel is an expanded view of the left breakpoint depicting disruption of MTRNR2L4. The lower right panel is an expanded view of the right breakpoint depicting disruption of ALG1. One or both genes may be causative of the patient's autistic phenotype.

In the figure, three tracks of information are shown, from top to bottom: 1) RefSeq gene annotation showing the genome location (x-axis) of genes demarcated in light gray (introns) and dark gray (exons) and with multiple entries depicted if multiple transcript variants are annotated that correspond to the gene; 2) size and genome location (x-axis) for normal CNVs annotated for greater than 1,000 unaffected/normal indivduals, with CNVs demarcated by dark gray bars and the y-axis corresponds to the number of individuals in the normal cohort found to have the CNV; 3) array CGH data (black dots correspond to the probes on the microarray) for an ASD case with a CNV wherein the y-axis is the log 2 ratio value of the test (ASD case) and reference (healthy control) genomic DNAs and the x-axis corresponds to the genome location of the probes and CNVs, which are depicted as line segments shifted positively (copy number gain) or negatively (copy number loss) relative to the baseline (log 2 ratio=0).

Example 8

Figure 6:
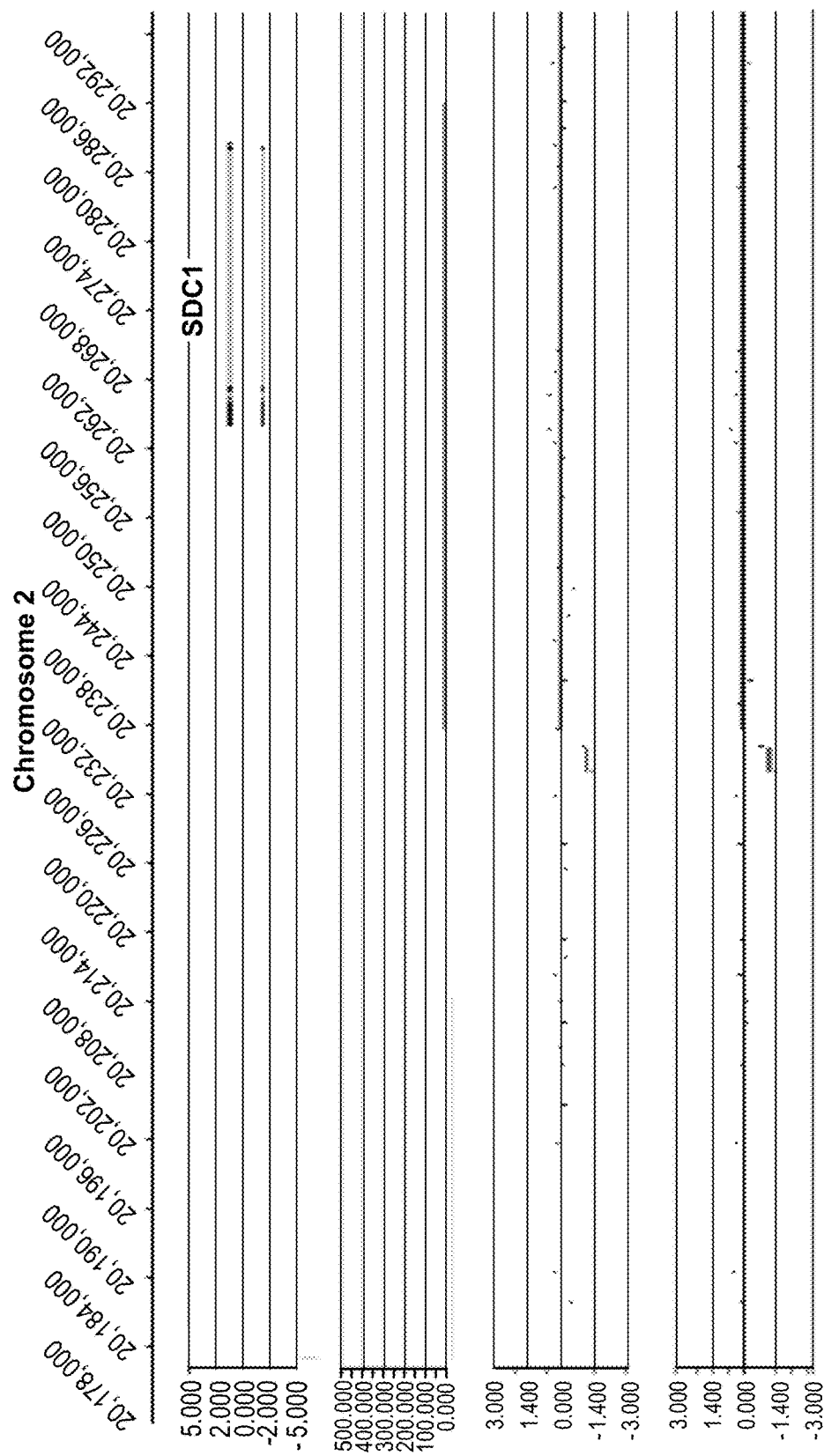
FIG. 6 represents an example of group 6 (High OR intergenic (OR>30)). There are 20 ASD cases in total (5 representative cases are depicted) and 0 NVE subjects affected by an overlapping CNV-subregion that impacts an intergenic region (adjacent to SDC1). The CNV are losses (log 2 ratio<−0.35) on chromosome 2. The calculated odds ratio (OR) for this CNV-subregion is 30.33.
Figure 6:
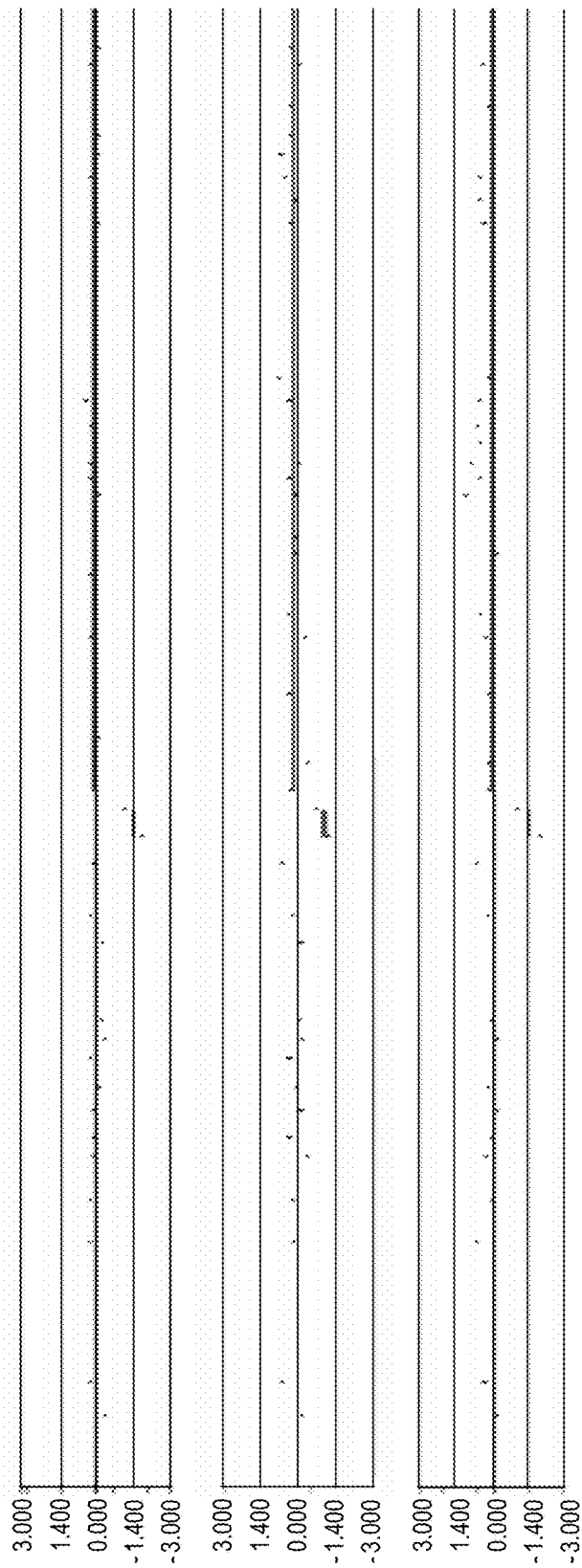

FIG. 6 represents an example of group 6 (High OR intergenic (OR>30)). There are 20 ASD cases in total (5 representative cases are depicted) and 0 NVE subjects affected by an overlapping CNV-subregion that impacts an intergenic region (adjacent to SDC1). The CNV are losses (log 2 ratio<−0.35) on chromosome 2. The calculated odds ratio (OR) for this CNV-subregion is 30.33.

In the figure, three tracks of information are shown, from top to bottom: 1) RefSeq gene annotation showing the genome location (x-axis) of genes demarcated in light gray (introns) and dark gray (exons) and with multiple entries depicted if multiple transcript variants are annotated that correspond to the gene; 2) size and genome location (x-axis) for normal CNVs annotated for greater than 1,000 unaffected/normal indivduals, with CNVs demarcated by dark gray bars and the y-axis corresponds to the number of individuals in the normal cohort found to have the CNV; 3) array CGH data (black dots correspond to the probes on the microarray) for an ASD case with a CNV wherein the y-axis is the log 2 ratio value of the test (ASD case) and reference (healthy control) genomic DNAs and the x-axis corresponds to the genome location of the probes and CNVs, which are depicted as line segments shifted positively (copy number gain) or negatively (copy number loss) relative to the baseline (log 2 ratio=0).

Example 9

Example of Sequence Data

The sequence file ASD_ST25.txt contains genomic sequence information for (in the following order):

A. All distinct CNVs listed in Table 1 (SEQ_IDs 1-883);

The full genomic extent of the transcripts listed in Table 4 (SEQ_IDs 884-1,690);

Example of Sequences Submitted:

Sequence Entry Starts:

```
SEQ_ID 1 = 1,337 bp loss/gain in an exon of MIDN, as listed in Table 1:
<210> 1

<211> 1337

<212> DNA

<213> Homo sapiens

<400> 1
ggaacgttga tacattataa ctttttttc ttgttacttt caccccaga tcctccgagc    60 ggcggcgacg gctgttgcta agggagggga cgcgcgagga agcgcgaccc gggcggcaga   120
cggcacccag cgccaccagc cgagcggcgc cccctcccca ggacccttaa ccgcgccgcg   180
tcccggtcgc gcccgccgcc ctttgaagga gaagcaagtg ccgtccccac ccccggaagg   240
cgcccccagg agccggagcg acctcggagc gccactcgga ttttggattt cggtctcgca   300
ttccgcggcc gggactttct cgaggaggac gcgcgctgct ccgcgccccc gagtgcccgg   360
aggacccggc atccggggag cctctcgccc ctgtcccgga ggcgcggcga ggattggcgg   420
cgcccgccgc cccagcccc ccagcgcgcg ccggggatgg agccgcagcc cggcggcgcc   480
cggagctgcc ggcgcggggc ccccggcggc gcctgcgagc tgggcccggc ggccgaggcg   540
```

-continued

```
gcgcccatga gcctcgccat ccacagcacc acgggcaccc gctacgacct ggccgtgccg    600
cccgacgaga cggtggaggg gctgcgcaag cggttgtccc agcgcctcaa agtgcccaag    660
gagcgcctgg ctcttctcca caaagacacg taggtaccgc gcgcccccgg ccggccgccc    720
cctcgggccc cggccccccgg gcgggaacaa agagcgcgcc gcgcggggaa ggcaggggggc   780 ggccagacag ggggcggggg cgcgccgcgc gctctcgggc gccctctgct cggcctcgcc    840
tgcctcggcc ccctccccg ccggggtcg ccgcacaaag gcggctgcga gggcgtcccg     900
ggccgggctt cggcggcccc ccttgggggc gggcaggaat cccagggcgt tgcgggggtc    960
ccggctgcgg gtgtggggggc cgccaccgcc ccctcccgcc tgcgtccgcg ccggcttccg  1020
catctgctcg gcggcctcct ctgcgtctgg ctgtctcccc ccacttgcgt ctctctcccc  1080
ccctttgttc tcgcctccga gcgctccccg cagcctcccc tcccccctgg tatttaaatc  1140
gcctgcaggc ccggagccct cccccccgcgg gcctccgggg acacgcagtg tccatcccag  1200
tggaggggcc catcggggga ggggcggagg gggagggtct cctttgtctg cgcggcggcg  1260
gccgcctgcg ccggggaggg aggaggaggg ggagcccggc ccggcgcaac ccccagggcc  1320
tctcctcggg ccgaaac                                                1337
```

Sequence Entry Ends.

Example 10

Example of Sequence Data

Example of Sequences Submitted:
Sequence Entry Starts:

```
SEQ_ID 1168 = Transcript NM_019103, corresponding to gene ZMAT5, as
described in Table 4:
<210> 1668

<211> 36025

<212> DNA

<213> Homo sapiens

<400> 1668
tgtggtgaca gactttcttt ataaacattt ggaagttttc tcccccatct tcttaagaag     60
caggggggca ggtggaggag agtgagggga gagctgcccg gtgcagaccc aggacgaggg    120
ctgcacttgg tgtggccgtg tcctgagcct cagtgaggct gggcagatgg tctcggagcc    180

... (sequence truncated for brevity)

caagaaatgg tgcgtcccgc cgcagggcgt acgcacagag aaggaagtgt tcaagtcttc   35940
cagtgcggag aaaagagact aggactcgcc cctcgacgtc tcgcggaagg tacctggctc   36000
cccggtggct gcagctccgg gctcc                                       36025
```

Sequence Entry Ends.

SEQUENCE LISTING (1690 sequences)

SEQ ID NO: 1 - DNA, 1337 bp, Homo sapiens
ggaacgttgatacattataacttttttttcttgttactttcacccccagatcctccgagcggcggcgacggctgttgctaagggaggggacgcgcgaggaagcgcgacccgggcggcagacggcacccagcgccaccagccgagcggcgccccctccccaggacccttaaccgcgccgcgtcccggtcgcgcccgccgccctttgaaggagaagcaagtgccgtccccacccccggaaggcgcccccaggagccggagcgacctcggagcgccactcggattttggatttcggtctcgcattccgcggccgggactttctcgaggaggacgcgcgctgctccgcgcccccgagtgcccggaggacccggcatccggggagcctctcgcccctgtcccggaggcgcggcgaggattggcggcgcccgccgcccccagccccccagcgcgcgccggggatggagccgcagcccggcggcgcccggagctgccggcgcggggcccccggcggcgcctgcgagctgggcccggcggccgaggcggcgcccatgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacgtaggtaccgcgcgcccccggccggccgccccctcgggccccggcccccgggcgggaacaaagagcgcgccgcgcggggaaggcagggggcggccagacagggggcgggggcgcgccgcgcgctctcgggcgccctctgctcggcctcgcctgcctcggccccctcccccgcccggggtcgccgcacaaaggcggctgcgagggcgtcccgggccgggcttcggcggccccccttgggggcgggcaggaatcccagggcgttgcgggggtcccggctgcgggtgtgggggccgccaccgccccctcccgcctgcgtccgcgccggcttccgcatctgctcggcggcctcctctgcgtctggctgtctccccccacttgcgtctctctccccccctttgttctcgcctccgagcgctccccgcagcctcccctcccccctggtatttaaatcgcctgcaggcccggagccctccccccgcgggcctccggggacacgcagtgtccatcccagtggaggggcccatcgggggaggggcggagggggagggtctcctttgtctgcgcggcggcggccgcctgcgccggggagggaggaggagggggagcccggcccggcgcaacccccagggcctctcctcgggccgaaac

SEQ ID NO: 2 - DNA, 20970 bp, Homo sapiens
ggaacgttgatacattataacttttttttcttgttactttcacccccagatcctccgagcggcggcgacggctgttgctaagggaggggacgcgcgaggaagcgcgacccgggcggcagacggcacccagcgccaccagccgagcggcgccccctccccaggacccttaaccgcgccgcgtcccggtcgcgcccgccgccctttgaaggagaagcaagtgccgtccccacccccggaaggcgcccccaggagccggagcgacctcggagcgccactcggattttggatttcggtctcgcattccgcggccgggactttctcgaggaggacgcgcgctgctccgcgcccccgagtgcccggaggacccggcatccggggagcctctcgcccctgtcccggaggcgcggcgaggattggcggcgcccgccgcccccagccccccagcgcgcgccggggatggagccgcagcccggcggcgcccggagctgccggcgcggggcccccggcggcgcctgcgagctgggcccggcggccgaggcggcgcccatgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacgtaggtaccgcgcgcccccggccggccgccccctcgggccccggcccccgggcgggaacaaagagcgcgccgcgcggggaaggcagggggcggccagacagggggcgggggcgcgccgcgcgctctcgggcgccctctgctcggcctcgcctgcctcggccccctcccccgcccggggtcgccgcacaaaggcggctgcgagggcgtcccgggccgggcttcggcggccccccttgggggcgggcaggaatcccagggcgttgcgggggtcccggctgcgggtgtgggggccgccaccgccccctcccgcctgcgtccgcgccggcttccgcatctgctcggcggcctcctctgcgtctggctgtctccccccacttgcgtctctctccccccctttgttctcgcctccgagcgctccccgcagcctcccctcccccctggtatttaaatcgcctgcaggcccggagccctccccccgcgggcctccggggacacgcagtgtccatcccagtggaggggcccatcgggggaggggcggagggggagggtctcctttgtctgcgcggcggcggccgcctgcgccggggagggaggaggagggggagcccggcccggcgcaacccccagggcctctcctcgggccgaaacccgtggttcctacaaagaggagccaggactagaattagggaattgggggcaggggctgccctggggtcgtgggggaaggtggcatagagcacactggggcccagaggaggagaaagtgcctggttggggtgcagagggggtgccagagtccagggcgggggttccactggagggaaggggtccgaatcgccaggatggggctcccagcaccagacggagacctctctgcacgcgcttagggccctggatctggaagccgggaaggggtgggggtgggaacttatccgtctctccccacacaagcacagccctcccccgcggcctctgcttccgcgtccctgtgtcgtctccgcggagtctcatgctcttccttcctccccccagccggctcagttcggggaagctgcaggagttcggcgtgggtgatggcagcaagctgaccttggtacccaccgtggaagcgggcctcatggtaaatggccatggggctgcgtgcccccagaggcccccgcacacaggcagtagcccctccctcggtacctgtccgcacacacactacctggggcccccaccccgccagccagcagggccctctccaccccctattccagcccaggattccgaccccacactcaggcccctctcctccctctctttgtagtctcaggcctcaaggccggaacagtccgtgatgcaagctctcgagagtctcacggagacgcaggtaagacctcgccagccccttcctaacagggcagccctgggagcagggtgccttggccaccgacggggcctgggggttgtctgtgctcccaggaggctgggggaggggaggggacgcgccaccccgcctgggtgccagcctggcctggcctccccacctcctctcccccaagattcaccacctgacccggagggctttctctcccacggtggctgccctgggggaagggggcctggctttcacaagactgcctgcaggatgaccttggcctatggggcctcatccccgctcacaccctggcctgcatccccagccccctccgcccccaccgaggagcccccctccagccgctgtggcttccccagagcgagtttctccttttttacatttctgctgagggctgggggtggcggcttgggtgacactccttccgccttccgtgacccccatcgtgagagggtggggatctcgtcaccctcccctcctctctctggcctttgttctctaccccgaaaggggagggggcgggggtgcccagccctggggccagtgaggcctagacaggatgttaggaaaatatttagtaagcggccaggagggaggctggggctggccctcacccggttcccggttttgctgcggacttttttttttttttctccttctttcctcattttcttggctgcggccaagccttcctcagacaagggccctggccacctcccaggagggtgacacaggcctcagcaatccgcccgctgccagggtgggggacgcaggctgccacccgccccagcaaggggtggccggcttcccgggcctccctggccccgaggcccgcacccccttccgctttcccagcggcatgtagagtcctgccctttccctacatcgcgggggcagggcgggggccgggagctgggtggtctgccatgggggtggccacagcagcagcagcagtggcgtgggggcagagccggggtcccgagccagggcgggggctgcaggtgatttcctggggcgagtgtgagcagagctccccgccgctggggggctgcggttggcagggggcccagggcgtgttggcttcacaccctcctccctgggcgcctgcgtcaggaaggagctgggttggggggggctggagggggtgctgggcggagacactgggctccccagggttgcttccctgcctggcaccgagtcatgcccgcccattagccttccccagggaggaagttgcagggcgggtggtggtggggactccagctgctctcgggaagccaccccgggcccttcctgcaaaggctgtcttggggcaggggggtagggggccgggcaggctgggccgcagggtgggggcttcaccctgccctcctccctgcctccctccccatgggccccaagcagagaaggttacgccagctactgccagtggagaggagagccgggagggagagctgggaggcggtcggttctgagtcatcccagcctatgtcacttctcagaaacctccgccacccccccccccatcccggccactggggagagcagggctctggcccatacccagagcagggggcttggcgaggacagggtgagattcaacccacacccaccctgaacgggggcagattgagggtttctgtgcttggagcaggttgtgccctccgggactccagccccagggcggtcagggccccttcctgcagccttgccacagccccctaggcctccgccccgcccaggacagataaatatttatcttgagaaagcaaaggttaggacagaagaattcgtgcaggaattccacccacttgctggccctggtgacttagctgggagggggcctgaggtggagcccctcccgtatccacaggcagagaggatctaggggcccatgagggtgggggaaaggcaaagtgaaggttgtttgaggtcagtgactgccagctgggccccgccccctctggcctcagtttccccttgcaagaccgacctagttggccagggaggggcaggcccccgtctgacccgcctctgtccccacagcccccagcggcgcccgggccgggccgggctggcggaggaggcttccggaaatacagattcattttatttaagcgtccgtggcaccgacagggaccccagagcccagagaggggcggcgagaggccccaggtcacagcgcggggggactgggccgggctgggctgggggcgccgcaagctggggctcccagctgacggaccgctctccttgcaggtcagtgacttcctgtcgggccgttcgccactgacactggccttgcgtgtgggcgaccacatgatgttcgtgcagctgcagctcgcggcccagcacgctccactgcaacaccgccatgtgctggccgctgcggccgccgccgctgctgcgcggggggaccccagcatagcctcccccgtgtcctcgccctgccggccggtgtccagtgccgcccgagtccccccggtgcccaccagcccgtcccctgcatctccctcgcccatcacagccggctccttccggtcccacgcagcctccaccacctgcccggaggtgagcctggggaagggaagggtgacccttggttggaatccaaagggtgggccgtcctggggaggtcttggggaggacaaggactcttagtcccaggtgagtcccttgtattaagggctatcctgtgacctcgggctggtgggtgatcccccagcctagattggtggggtatttctagatcctgagttgacggtcatcgcctgacatgacctggaccagtagatgatctcttgatctttgactcatgggtcatctctgtgtcctgggttggttgtgacctcgtgaccttgggctagtttatctctaaaccctgtgttgacaggtcatctcctgacctgggctggtgggtgatctctggtccctgggttgctggtgatcccctgatcctggaccccgtgctcatgtgccccttcctcccatcagcagatggactgctcccccacggccagcagcagtgccagtcctggtgccagcaccacgtctaccccaggggccagccctgccccccgctcccgaaaacccggcgccgtcatcgagagctttgtgaatcacgccccgggggtcttctcagggaccttctctggtaggtgtcacagcacatgtgtgagctcacgtgtgtcccgtgaccctgtgcatttggggtctacatccacccacaggcgactccacatattctgggcatacacaggctgtgtccgtctgctcacttcacatgtcccccaggaatcccccacacacacgcctggccctgcccggggggccgcgggtcaccaggcgcctgcatactggggacgtgtcccgctcccgccccgtggtccctcgtgcacatcagcccacatgtccacgccattgcctgagctcatgagctcacacccgtggacgcccgtcctggacatgcgggactgtgcccgtgccgggcactcacggccacctctgcccgcaggcacgctacaccccaactgccaagacagcagcgggcggccgcggcgtgacatcggcaccatcctgcagatcctgaacgacctcctgagcgccacccggcactaccagggcatgcccccttcgctggcccagctccgctgccacgcccagtgctccccggcctcaccggcccccgacctggcccccagaactacctcctgcgagaagctcacggctgccccctcagcctccctgctgcagggccagagccagatccgcatgtgcaagcccccgggtgagtggccaccctcgggggtcctaccttccccgcccgcctgggcttctcaaggcccctctgtgtgagctggtgggctcaggagcagctgacctgcccaggggctgggggggatggcagctgccgtggccactgctctgctccagcccggagagaaggcagcatgtgtgtcagggcacaaagtgtccttgtgtgctcccggggggccacaggcccacttcctcctgccccacccccacccggggcatcatctccagatggcatttggtgcctctgtgaatggccaagtcaggcctggcaggccgaggcggggccagagcccacccctaagcatttcagtgacttggaaaagcagcgaacacaacccccctgccagcctggccccagctactcccaaacggcgggttactccctccagagtctcaccagaagatggctactgtactgcccttgggctctgcacccgtcgcgggggctcctcccagctcagtttaaaagtgggaaactggccgggcgcggtggctcacgcctgtaatcccagcactttgggaggccgacgcgggcggatcacgaggtcaggagatcgagaccatcttggctaacatggtgaaactccgtttccactaaaaatacaaaaaattagccaggcgtggtggtgggcgcctgtagtcccagctactcgggaggctgagacaggagaatggcgtgaacccagaggcggagcttgcagtgagccgagatcgcgccactgcactccagcctgggcgacagagcgagactccgtctcaaaaaaaaaaaaaaaaaaccaaggtacaacccccaagtatctcccctcggatcacagaagcggccaagccccctccatgtaggactccaggaagaatgaggcaggacagtcctgacctccccagctcatggctgagctggagaattagaagccagctgcgtagctgggactccaggcaaacaccaccatgcccagctaattttgtaatttttgtagaggaggggtctcgctctgtggctcaggcctgtctcgaactcctgaggttgcccaggcctgtctcgaactcctgagctcaagcgattctcctgcctcggcctcccaaagtgctgagattacaggcgtgaaccactgtgcccggcatggtggatgtccttgactgtttcctttgctgacctccctccagggagggcaggactgtgtctgacctcaggggcatttgctggggtctggggtggtcctctgtgttcagcaggtggaggctttgggagtcacaggccactacctcctttgcaggggaccggcttcggcagacagaaaaccgcgccacgcgctgcaaggtggaacggctgcagctgcttctgcagcagaaacggctccgtagaaaggcccggcgggacgcgcggggtccgtaccactggtcacccagccgcaaggccggccgcagcgacagcagtagcagcgggggcggcggcagccccagcgaggcctccggcttgggcctcgacttcgaggactccgtgtggaagccagaagtcaaccctgacatcaagtcagagttcgtggtggcttaggatcttcggatcggccaccctcgcccctcgcaccccagcccagggcggcggggactccgagagccccggagagaacgtggcccagccctggagggcaggcggccactcccccagccagaagtctttttttcttttcttcttttttattatttttttctttttttaaaaagttctgaccgtggtttcctggactcttcatgggctttgcttcctacctccttcacccttcactcctgccctcctcttcctcctcctcctcctcctccgtctgtctcctttcacctctgcgccaggtcggtcctccctgccaaccttccccagctccaatatgtagcagtctctctggatggcggagagtgaaggagacggagaaacgcgccccatcccttccgccgcctcctttcccccccgaccctattcaggttttaagtcaaaaatgtcgatatgtcattatgcactttacagatgaggggaggggccgcagtgcgcagaacccaccccaccccccagtgcagacttcggggtctccaccccaggccagcagcgcccactgggctacagcaagccaacaggtcacagaagccaacgaggggactgtttctcttccactcctatcctcttttcttgatcttttttttgcattttccttcatttctttaacaaggagagcaaagctgttttagcagaggctggggctgaggtccccatggggtttgggtgcaggggcatggcaccctttcctgtcgggaagggagaggggaactacccccccagcctgccctccgccccgccccagccggcggactgtgctgtttcctccgcccccactcccgtgttttctgacctcctgcctgagtttggggtatttatagactattaattttctgactgagccaatagtggttggggaactcttgaaaaaggggagagaatggctgggtgctggggagttcccccctccgagccctccttcccggcccaacctgagggatgtggatttgggactgtctgggggcccctcctgcagcgaggatgggagggggtgctgagctgtgaatcccctgggcagggggcgacaactccgtgtagcattaacccccgtggcggggtccgctgctggtctaatttggaccccctgcctctcagtgcccctgccctaggggtgtctgtctccagaggggagggacaaatcccctactggggccatttcaatggggtagtttttggatttttttccccactcactttttattttttaatgataatggagatgtctggacccttcctcaccccacctgtcggtcttgtcctggctctgcctgtcccccaccgttgttctcgtaggtgaaccccaggtcctcaactccccccctttatgtgttgaaagttaatggtttcagatgtgaacatcacgtgttataactgtagcgctgtaaatttttttgtgggagggtgggcagggaggggtcccagagggtagagctcaaggattttgggttttgttttgttttcatttttccaaaaaaaaaagaaaaaaaaatagaaaaaaaaggagtaaaaggggcgggtttgttttttgaagaactgtcttggatacctatttaaatgtgtgttctgttttgttttttaacgatttttaaataacgtctgtgcctccactggttgagggtggaacctccaggcaggaaccggctcgccaccctctgcccggtaagggctgcccaagaaagcattacccgccctcggggggtcgggctgtgggggtcccggcacctggcgtgagtttcatgtatgaaaacataaaattgaaaaaaaaaaaaaaacctacacgagcaccgtgatttcaagtaataaacagaaaatgaaacacacattgactcccgcctgctcgcctagtggggggatctggccttggttgggagggttcctggggtgggatgtcagctcagggagtcagagggactgacctgggtcccaaggccccgaagagggggtggggcaggggtcagggccctgagaatttcccacgctccttccccggctgccgggtgggcaggaagcagccagggtgggagggaggagcccagccacttcctggtacccaaggccggaagtcccttagggtgtggggcgagggcctgcctgcctgcttcgtggcctgggcaggaccctggccccctcaggacctgccagtatgggggagacgcgaccaccagctctccccagccacaggagtcggggactcccactctgccacacccacctgctccccttcctggagtctcacatctgtgtggcttgctgcagggagatcaccaggccgactgggaggacctaggactccgcagggtaccttgggctggcaggtgatacaggcctggcttgacccagccctggggggcctctctggccacacctcctgacattccagcccttcccagacctggccttcagctccaaacctcccggcctttgccccctgtctaggaacacccctggtccggctgtcccttgctgtctgggaacttccccagcctgcgccttccacccctgtccaccccgtcccgcagaccccacccttccctctctctgtccctagcctggagctccccgtgagcctcaccaggactgagtcctctctggggtcccacctccacccatgtccgggctgggcagagatgaggcaataacactatttcatgtctttttttaaattttgtaacctgtatttcctcaggtaacaagagttgcctatgagaagtaattgggctcccattttatagatgggagaacagaggcccaaagaggaacatcacttggcccagaggatttggggtgtttgttcaatgatgtgacctccaccccttatcccatctctaggggccccagtaccgggagcccccaggggaaggggcacaggttcagagagtggcctgggagcaccttcctgagacccctctgcccctcccaacgcccagtcaaccccaaatcatcgcacgcccacggcaggaaggcggatgcccagtcaggcggcacccaccccccgccccgtccctggtgcggatgtcccctcggggctcagggtgggggtgcgggtcaccgacgccaggcctggggtcaaggcgagggccccagggcgccaccgccccctcgctgggcggggtgggaaggaggaaggaggatgttgtctgaagcacctgctgaatcacaggggctgtgtctgtagcctgcagggtggggggcgcgtcccctgcactccaggacccgcccctcgggatgccgacccccaccccagactggggatcccaggggtcaaggctgtgccctgggggcgtggggtggggtatggagctccaggctcagagccctggcctggtagggtcagcccaaccaggggtgcagcgggcggaggggcggcaggcggaggccaagtgtgcgtagggaagcacggagaggtaaactgaggcacaaagagggcagggaccgctgggatctcgcggggcggggtcggccctggatcgctcccttcccccaaccattgaggaaaaagctgaatgggagggggcggcccccggaaacccgccgggatggaaacgcggtttccagggcaacgcgccgcgaaaggagcctgacgtcaccccgggtagggcgccctgcccgcccccgtccgcgcgtcgcgcggcccaggccccgcccaccagcggggaagcctcattggtgatcgcaccgctcgctcatcggcgtgccccagtagcagcgcgacgaagcctccagaaggcgggacttcagcccggcagcgccgagtgcgcaggcgcaagcgcggaggcgctgcagccccgcctctctccccgcgcgtctgcaaagttgggggcgggaggcgcagccgagggtctgacggctgcggcggggcctggacggaagagggggcgagccccggggcgccgcacgtggacccccggcacgggcacgctcacgtgcacccgtcctttcacgccaacgcgtttcctgctgcccccacccctgcaccactgcacgtcccagaccccggcccagcctccccgcggtccctaggctgggggagctcagacaggaggctaggaggagggggactttggggctgaggctttgccaaaggagcaggagtttgccaagtgttgtaggaagcgggaagggtgcgccaggtagggggcacggcgtgtgccaaggcccggaaacgtgaaaccgagtgcttttcgggggcaaccgggaagtcagttggtggagaaaaatcaaagatgggaggaaaggcgaggctgacaaggaccctaaacggtgattccccaagtcggccactggagggatgacttgggggaccagagaggaagagcaggtgagggggagcggcggccaggacatctgggaggtggctagacccgtggcctggactttggggggcggtcgagttggatcgatgatcgatggggaccctggcggcctcaccctgggggaggtagagacgaaaaaggaactacggtgtgcccggaaggtggtggctttaggtccacagggaggtggttggcaaggcgggggtaacagggggaaggagaaaatctgaaatgccggtgtgagctccgggccaagagagttgaggactcaggaggcaggaatcccccgtggccgcccgctgcttggctgtgggctccaacttggtgtgtgctcagagaaggcagtggttggagtgaacagggcctgtgccaggtggggagactagccaaggtgtttgtgcagcctggcctctggagcggcctgggaagagctggagttcgcagggtgggagctgccctgtggctgggagcccgtgctggcgtccctgccaggcggtgatctcacaggtgagcggtgcttggggagacgcggagctgtgggcgggcaggagaaggtcagtggaggtcatggcttttggcttgaggccggagtcctctgggggtggccgaatgcgcccttggagctgccttgggaggtggctagggtggacagcagtggaagccaggcccttggcttagagccactgggttggagggattgagccagtgcccgggcacagccgcccccacagggccttgccccacccgccctcctctcccagcaccatgggaatgggagttaccgggctggaggctggggacgccaccaccccgtggccaagggcgttggggcccaacccaggagcctggtgcagccccacccacgggccgcccagccctggaagggcagagaactggctgcctctggggtcacttgggacaggtgagcagcccagcccagcccagcgggtgggggaggggaggctgtcacctgggccctgcctccaccctctttctggttctcactccctccatttctctttcttttgcctttctctatttctgtcccgatctctggcgctctccccaacccagtaccaccatctccgcccctccgtccctcccctgcttccgccccctctctgggggcccccttcaccccggggcacattccagcttcctcccccgccttgcagtccctccctggagccagctgcctcctcggttgccagagcagagagagtgggcttgggccgaggtcggaggtcgaggagcgggcgggagcctgggagggcacccccaacccctctggaatgtgggtggagcggggcaagggagacagctggtttccacggagggcacatgccccatacccaggacgctacccacactcagccctgggggagagcaagcaaaaccaatgggtgccatcccacgaggggcctgcacagccatcccacacccccgaccagcacgcccgggacagccctccacaggccacgcatttatgggtgcggctggtgtgccaggctcccagatacacaacccccccccccagacacaccccatatacctgtccccaacctcaatccactgtgtgaccctaaaacaaacagaacctccttgctcagcctgggccaaggcctccccaaacaaaactccagcctgcagagtcccaccacacaccgcagctgtcaccagatacaaagagggccctgaccagatacagagagggcagcagccttcccccacaaccaacacacgcctgggcgggggcaggaacacccccagggcctccagccacagacactcacccactcacccctctgtgcaccagtgatcctccgctgcccagccaagcttgactccagcctgctggagtctgggtgggggatggagaggggttcccaggcgagccccaacctatgccttccaaaagtctttctgtgcatgttggaaatacaaatgaaacaggagagttagcatacgggacaattattatttttgtttgtttttgttttgagacggagtctcgctctgtcgccctggctggagtgcattggcgcgatctcggctcaccgcaacctctgcctcccgggttcaagtgattctcctgcctcagcctctggagtagctgggattacaggcgcccgccaccacgcccggctaatttttgtatttttttagtagagacgggctttccccatgttggccaggcaggtctcgaactcctgatctcaagtgatctgcctgtctcggcctcctaaagtgctgggattacaggcgtgagctacagcatccagcccaattttatttatttttagtagagaagggatttcaccatgttggtcaggctggtctcaaactcctgccctcaaatgatccacccgcattggcctcccaaattgctgggattacaggtgtgagccaccacacctggccccagttattagtattttcgagacggggtctcactctctttccaggctggaacgcagtggctccatcacagctcactgcagcctcgctggaactcctgggctcaagcgatcctcctgcctcagcctcctgagtagctgggactacaggtgagcaccaccatgcccagctaattttgctttttttttttttttgtagagacagggtctagctatgttgccccggctggtatcaaactcctggactcaaacgaaagtgctgggattccaggcatgagccagcgctcccggcctgcatacgggatgattccatgtggactgccacatcaaggaagcaaacaacaaggaaagcctggcgctgcgtggagctgtcttttgctgctaactgcccttgaccgacttcctaccaggtcttccctgtgcgcctctaaccccaggaggtgctgctggcatgcccacctctcagatgaagcagtgcggtccagagagcgtcttgggcaccgcctgcctcacagctgggcccctgaccctccagggactgtggctgagcagccatggctgcctggacgggtgtcccctggcccgtctgtccgtctggatgtgggaaccctccaggcacgctggggcgggcaggtgccaggtgcctctccagcaagatgcaacataggtgtcttcacttgcactccgtaggtcctgagcccctgcagctgcctgggagagtggggaaatactctccacttgtcccactccactgttgccatggagatacctcccaccctaggcagggccaccctgagcctggttggctttgcaggaaatccccactctttgacctctctgttaggcacaggacgtgtagtcccatgagagggaactgggcccaggtggagatccatccgcctaccccagagcgcgcatctgttgctaagcaacatctgaggctgcatggaggtgggggctccggagcccccagaccttttcccagtttcagaaactaggtggctgcatccccagcgtccacgcaggcgagcctaagcctcggtcagctttagggtgtccgtgggccatgcagggtcttgggcctttcacagacacctgatctgcacgtcacagacacgcatgggtgcacgtcactacacgtccgccacatgtgcttggctggtctgcgccccagcagaaggggtcacctatgtctctgcagtatcctgtgtactgaaagagcaaacaggtgtgtgaccccagggcaggtcggggtccgtcctgtccccagcctgtctactgcgtgtgcctgtggcaggcagggtctccggatgccgagtgcatggtgtatgactttgtgtccagtgggtacgaagcaggggtgtgggtgtgcacctgtgtgtggcctgtggcggggtgtgtgtgccggggatgtccctctgtggcccaggcctggcctttgggctgctgggatggcctggccggggcaggagtagacagggcctcccagcctccacattcctgagctgtgactcaggcctgtggggagggggtgagtcacagggaagggaagccgacccaccctgcgaacgcatccgaggaacaggagggaaactgaggctggggagcagctcagtccggctttcctgtgtagcagcccctgaatctcaggcccgggggtggggcggggtggcgggggggggcgcgcggggcctcccaggggacctgagatcccagccctggactcagctgggagctgggggaagaggcaggtttaacccttcctcttctgggcttctggaactctgggctgccctgggaggcgcggctcccgctgacacagcacgcgtgcccaccccagggacatgagtcacagcaccaggcatggacacatatgctctgtgggtcccggcacacccgagtcacgcacacccagccctgtccccggctgcccccacatccacatccggataagcgcacactttggagtccaagcgcccacctccttgggttgcacacacagcgccacgcagacgggttcctgtgtctttgcacacacgcgggtgccgggggctctgtgcacacacctccaagactgcgtgcacgcccctatatgccctgcgcaccgacgcaggccggcctggggtccctgcactcaccacgccgtgtgcactcgcacatagctacacattcgtgtccacacaagcttgtgtctctgtactctgcccacgggcacacatgtgcgccacacctggcaacccgcacgcccggtctctgcatcccccaccctggctctgggccccgcgtagtggggccagctgggtcggctgcagcctctgccaggacggtcctatttctgcgcccccgcggggcggccgccaggtgcacggtcccggcccccgcctggctaggaggaggcggtaattatgcggccccggggtcccccccacgcgcctttcatcctcggccacgcccgtcgcaggcctagacgctctctaccgcctcccgcccggtcattagtcggggtcgggggaggacctggcgtccggcgggcggggccccgtggggagggcggagtgggcggtgcgggagcgagggagctccgccctcgtctccatggcgacgccccgcaggggaggaggcccgggaggagtatcagggtgcaggaggtgcgcgccccttccgagacggcaggctggaaagggggcggatttgtgaatgggcccacggggcccaagacagacgcgcggggagcaggttcggggactctgactgatccccgcgcctcgccgggcaggggcgagccccgcgcgtcgggcccggaatagcagtctcgcccccgcccggcgcggctattttgagctcctccgttggggccgaggcgcgggggcggcgggaggctgggggtcgacacgcaggctgcgtcctcgccccgcgagattggacccctcgaggactgtgcgctgtggccgcgcagggctgggcggcggggccccctctcccacgcgaggcgtctgcgtggagcggcggcaccgggagcccggccgctcgagccaaacgccgcggacggagcgaggccgcagcgccccctggtgtccgcaacgggcagcgcgtcccggtcgggtcccgcatggtcagtggccagcaggggtggatgaaggggtcccagccgcctgagacccccggtggggacacaggatcgcggtgagatacctgggagtcacgggtgctcgcagacgcagctgaccccagaggcacaggtaccgacacaggtccacacctggaagccggtgcacagtgctcggcacagatgcaaagcggcaggtgtgcgcaggtgcgtgtcaacgccaccctgggaacccaggatggctgcggacactcacggagcccgcacccaggaacccgctcgtagtaagcgcttaataactaggcactggctgaatgaatgaatgaatgaatgaacacggcgcttcgcaaaaccaggaaaaggcagaggctcacagaaccagggaacgatgggctggggggagcggcaagaattacgcaattatgcaggggccgctgtgactaccaggcaccccctccaactccccccctacaagggctgctctgggtcagagaacgtccaccgcgctgactgctggggctgggggctgggggcgcagatcagaaagaatgggcctgaattgctcccaggctgggcatgtggcgcccgcgtctggggctccagtgggtgggtggcccctcccgcatggacggcgggcgcaggggagctcggtgctgatgtctctctcctttaataaccaccctgcgtgagtggctgacgcagcagccggctgccgctgacggggagtggggcggctgtagtgggggggcccgaggtgcagagggggtggtgatgaatcacacagctgctgcctgggggagggggtcttgagcccatgaggggtcccagagaccttgtcactggagacagcgcccctggctacccccacctcgatccacttgagggtggaagtgagtctgaggtcaggagtggggccgggatttccctgggatgagcagcaaagcgggggtctctgtacgccaacttcccccagcttgtcagcagagggtcatccctccgaagactttctggggcagagaggcaggggtccgcgctggcttcttccaccagggctgggggaggcggcggcatgagatgactcctgggcgaggagcaagtggtggccatagagggccccccagaggctttggggccgccgaagagtagtgagtgagggtccttgtaaagctggttctccagatggcggcggctttaagactcccctccgccaaccaggctcagtaggggaggcctgtggaaggagagaaaaggcctgggtggaggagcagagtgggcctggccccgcgtggggagcgagtgcgccgttgctgtgcagcacggtgggaggggaggccgagggccgggcggagtgctggggtgcagtggggactcggggtgtccgcctgcacccgacagcagggacgcacaacactatccggccaggcgagtgtgggggtgtgggccacgcacccagccgtgataatcgcggttccagtgggagttaggcttgggtgcgggttggagtttgtaggcaaactgggttgcgtaaagttggggtgcaccaaagtgtggcgatgtaggaagaattgggattgcgaatattggggttcgcatgaatggggttgtctctgttggggttttggtgggcatggggttgatggcaggaatggagtgctggggtgctgggaaaactgggacgtcggttgtattggcaagaatatcacgacaggtgtcggggttcagatgaagttgggatgtctgacagccgggtcttggttgggtaggggatctgggctaggttgttatgtcgggactgctggagcacaggcaaagtcggggtcccagtgacacccagaagtccccatgaggcctgaggcctgggaatcggggctagaggcccatttgttccccgccgcaggccagggagcaggcacgcgtaactgggtcagccccgccccgccccgccgcgcgctggtcacgccccctcgagcgcgggtggaggactgcggactgcaaacgtctcggccaatagtcgagcccgacaccagtccgcgggagggggcggaaccgagatagactcggcccccagctcatgaatataagacgcaggcgcgccctctgattggcccaggatgtgtagggggcggggcccggcggaagcgtatataaggccgggctcggggacgcccccccctcactcgcgcgttaggaggctcgggtcgttgtggtgcgctgtcttcccgcttgcgtcagggacctgcccgactcagtggtgagggccctggctgcaccggctccgaggagctcggggcggcgggcggcctgcggcggccaggcgaggcggggccgcagcggcacgcccctgggagggggcgggcccggggtggagtccgccccgccggcggcgagggacagcgggagattgggccgagtagcggccagagggcctctccccgccggtccgggccgccggcgacccggttgccgccgcaaaatggcggccgcgagctcgaggctgtgcccagcgaaatggcgggagcgccgagttcccggatggagtggcgcagggtgcgcgcggggcgcatgcgcacgcggcgggggcggggccacgtggcgcccccggtctccagggccgctttcccggccttggggctggaggtatccacacaccaacgcttttgcttaccgagccttagtttcctccttttcccattgcgattgcatgagggaaaggacggcctcgtaaatcttgggtaggcgtggcccgttctagtgtggttcctcgtctgccacgtcgtgctttgcgcccaaagtttggtccaagttggcacagctcccagtgccagacttccaagtctagttctcagagccactgggtggcggccattcccagccagtgaatgctttgtctgtgtcagcactgaccgcccccttaaatagccagttctcctaaatgccacttcccctgcctggaaatcctgccttatcacttccggggccatcccttcccgattcccggcctaggtcctggctatggaagtcagtacctgccctgaggtgccccccaggacggggcggcctccctgacagccagccccccccccagtctcaggaggcattttacagtgagcagaagcacgttctggtccagcaacaagtagatgtcagttggttagggtaggagttggcacccgttcggaaataggagaacctgagagtgcagtcctgcccagggcacaactggaaggctgtgggggaagggagacacccattgtggaaatgggtgcggcctgccttcagtcttgggggtggatggagtaaattatttgaattaagaagtcctaggtggctgggtgcggtggctcacacctgtaatcccaaaactttgggtggccaaggtgggaggattgcttgagcccaggagtttcagaccagcctgggcaacagagcaagaccccatctctactaaaacaaatttaaaaaaattatccaggcgtggtggtgtacacctacagtcccagtttcttgggaggctgaggtaggaggattgcttgagcccaggaggtggaggctgcagtgacccctgcactccagtctgggtgacagttagacacactgcccccgaccccaaaaaaataagtcctaggtatgagtttgagataatgaaaaata

SEQ ID NO: 3 - DNA, 2608 bp, Homo sapiens
ggaacgttgatacattataacttttttttcttgttactttcacccccagatcctccgagcggcggcgacggctgttgctaagggaggggacgcgcgaggaagcgcgacccgggcggcagacggcacccagcgccaccagccgagcggcgccccctccccaggacccttaaccgcgccgcgtcccggtcgcgcccgccgccctttgaaggagaagcaagtgccgtccccacccccggaaggcgcccccaggagccggagcgacctcggagcgccactcggattttggatttcggtctcgcattccgcggccgggactttctcgaggaggacgcgcgctgctccgcgcccccgagtgcccggaggacccggcatccggggagcctctcgcccctgtcccggaggcgcggcgaggattggcggcgcccgccgcccccagccccccagcgcgcgccggggatggagccgcagcccggcggcgcccggagctgccggcgcggggcccccggcggcgcctgcgagctgggcccggcggccgaggcggcgcccatgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacgtaggtaccgcgcgcccccggccggccgccccctcgggccccggcccccgggcgggaacaaagagcgcgccgcgcggggaaggcagggggcggccagacagggggcgggggcgcgccgcgcgctctcgggcgccctctgctcggcctcgcctgcctcggccccctcccccgcccggggtcgccgcacaaaggcggctgcgagggcgtcccgggccgggcttcggcggccccccttgggggcgggcaggaatcccagggcgttgcgggggtcccggctgcgggtgtgggggccgccaccgccccctcccgcctgcgtccgcgccggcttccgcatctgctcggcggcctcctctgcgtctggctgtctccccccacttgcgtctctctccccccctttgttctcgcctccgagcgctccccgcagcctcccctcccccctggtatttaaatcgcctgcaggcccggagccctccccccgcgggcctccggggacacgcagtgtccatcccagtggaggggcccatcgggggaggggcggagggggagggtctcctttgtctgcgcggcggcggccgcctgcgccggggagggaggaggagggggagcccggcccggcgcaacccccagggcctctcctcgggccgaaacccgtggttcctacaaagaggagccaggactagaattagggaattgggggcaggggctgccctggggtcgtgggggaaggtggcatagagcacactggggcccagaggaggagaaagtgcctggttggggtgcagagggggtgccagagtccagggcgggggttccactggagggaaggggtccgaatcgccaggatggggctcccagcaccagacggagacctctctgcacgcgcttagggccctggatctggaagccgggaaggggtgggggtgggaacttatccgtctctccccacacaagcacagccctcccccgcggcctctgcttccgcgtccctgtgtcgtctccgcggagtctcatgctcttccttcctccccccagccggctcagttcggggaagctgcaggagttcggcgtgggtgatggcagcaagctgaccttggtacccaccgtggaagcgggcctcatggtaaatggccatggggctgcgtgcccccagaggcccccgcacacaggcagtagcccctccctcggtacctgtccgcacacacactacctggggcccccaccccgccagccagcagggccctctccaccccctattccagcccaggattccgaccccacactcaggcccctctcctccctctctttgtagtctcaggcctcaaggccggaacagtccgtgatgcaagctctcgagagtctcacggagacgcaggtaagacctcgccagccccttcctaacagggcagccctgggagcagggtgccttggccaccgacggggcctgggggttgtctgtgctcccaggaggctgggggaggggaggggacgcgccaccccgcctgggtgccagcctggcctggcctccccacctcctctcccccaagattcaccacctgacccggagggctttctctcccacggtggctgccctgggggaagggggcctggctttcacaagactgcctgcaggatgaccttggcctatggggcctcatccccgctcacaccctggcctgcatccccagccccctccgcccccaccgaggagcccccctccagccgctgtggcttccccagagcgagtttctccttttttacatttctgctgagggctgggggtggcggcttgggtgacactccttccgccttccgtgacccccatcgtgagagggtggggatctcgtcaccctcccctcctctctctggcctttgttctctaccccgaaaggggagggggcgggggtgcccagccctggggc

SEQ ID NO: 4 - DNA, 1254 bp, Homo sapiens
gtgggggagtcaagaggggaactgagcaaatttattgttttcttctttttaaaaatcttattttgagataagcataaattcacattcaagtatttaaaaaaacactttcatccattttctaattggatcattaaattttttaactgctaaatttgaaaggttgtatatattctagatgcaggtactcttctccagtttgtgatttccaaatattatctgatactcaatagctgttcttttcatattcttcatagggtgtatgacatagcaaaagtttttaatattgatgaatttcatgtcatcactttgtcctgttatggatcctgctttgctataaagactaattattgttcacctattcttagattttaaacattttttgtatctatttttctaaaagtgtaatagttttatgtttcacatttaagttgtgatctgtttatttaatttttgattatgtatcagacttaggtcaacattaattttgctttcctgtgcatgtccaaatgatccagcactatttagtaaaaaatctacatttccgtaaatgaaatgcttttatacctttctcaaaattagtttggcatacttgtttgagtctatctttgaggttctctattgtgttccaatgatctatgtttctacctctttgctaatgccaaagtcttgattattgtaactacataataagctttgaaatcaaccatactaaatcttcccacagtattattcatttttcaaaattatttattctagttcctttgtagtttgaaataaaatttaaaataatgttgtctacgtctacaaaaagtcttgttgaaatattgtcaagaatggcattaaatttataagtaaatttggggataattgctgtttcactacaagagactttcagtccatgagctcagcatgtctctccatttatatagatccccatcttgaacttcttctactagctttgtatagttttcaggatagaagtcctagacatgacttgttaaatttaatcctaagtattttatattttcttaatgagtgtaaatgataatttagatgtctacatgttcactgctactatacaaaaattacgatttttaactgatatttgctttgtatctgtaacccagttgaactcacttatgtagagtagtctttctgtacatctataaaattttctactttctgtcttaatcatctgtattattttatattattttagattcagggggtacatgtactgtatagccacttaca

SEQ ID NO: 5 - DNA, 7044 bp, Homo sapiens
acactttctcattttatgagaatatatgcggaataggaaaattagtgataacatattactttttgaataaaatgacttgtatttggtggtacttctggaatggcagaggggaggcctccatatagagtctcatacattaaaagcaacaaatatactggcaaaaatggtcaaaatctattttttccagagctatgggatttatcccaaatctggaattaatataaggggtgtttttttcaagaaaaactgctgaaccttactaataatggcatggaatatagcactgtaactcaactgctcccactcccctcttcccagtaggaaccttcaaaatcagcagcctcccatccctggtagctgtgcaaaacagcctcccagcaatcagggggaacagaccagatttggtgctcctcaacgcattcctttccccttgcccagaagactgtcgctatttaacctatcttgcattcccctggaaaactcaatttgcacatgttgctgttatttggcctgacatggagatttctccatggttagagccctatccccagctcatttgtttaaaaaaaaaaaaaagttgaaacaattgtttaacattgcaactgcctgaagcttctgtgtaaattggaacaagagcctggtcaaaacataaaaggaaggtctggggaaagacgtgctcacagggggctttgaaaagctctaccatattcacaaggttatgtgcatgtacaggcctgtgtgaatgctaagctgagagagaaccagtctctcacttacggatgacctgagatcctgcctaaaaaataagtgaaagctaagacaaacttgtaaattgttataatgttgaagttgtgcccaaacacacacacagacacacacagacacacacagacacacacacacacacacacaccagagagaaaaccttttgggataagatgaaagatggggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaatccgggaggcggagcttgcagtgagccgagatcccgccactgcactccagcctgggcgacagagcgagactccgtctcaaaaaaaaaaaaaaaaaagatgaaagatgtattgatttgcttatgacatttgaggaaatatctgacctataatttgctaactgagcagaagctaggatagccatgcactagaaagaatacagactttacagaattaacctgggaaagtcactaagtgaacaaatatcaaaacaatgaaaaacaggtacaggcagcaaaacctggaagggtgagaatatgatttccactgatggtacattctagtatttaaaataccatgttttcttttctttctttctttctttccttccttcttttcttttttttttttttttttttttttgatacagggtcttactgtcacccaggctggagtacagtggcgtgataacgactcatggcagcctcaaccttcccaggctcaagccatcctcccatttcagcctcccaagtaccagggactccaggcgtgctccaccatgcacagctaatttttgtatttttttgtagggatggaatttcatcatgttgcccaggctaggctcaaattcctggactcaactgatccgtccacctcagcctcccaaaatgctgggattacagctgcgagccaccacttcctgcactaaaatatcatgttttcaacaaaaattatgacacattttaagaaactggaaagtatggctcattttaaaaataagtggttagaaactattttcgaagttcagaaattggacatatatgacaaagattttaagttagctactacaagtatgtttaaagaatgaaaataaataaataaataaataaataaataaggaattaactgaaaatgtacaaataatgtctcaccaaataaataacactattaatgagaaattagcttaaaataaccagatggaaattctgcagttgaaaagttaaacaattgaaaaaagaaaaattcactaaaggaattaagcaagaaatttgaagttcatgaagaagaatcagtaaacttgaagataattcaatgagattatcctctctagggaacataaacagaaaataatgaacatgaataagcaaagcctcagaggcttttgggacaatattacacataccaagatctgcataattgaagtcccagagaagatgcaagaggtgaggacagcaaggatatttgggtgggaaaaaagtcgtcaaatactttcaaatatgatttcaaaatattaatctacacatccaggaaaaataacatatagagatccacacccagacacatcacagtgaaactgttgaaagacaaagtgagaatcttgaaagcagcaaagagaaaaaataaatcaagcatataaaagattaacaatgattaaggccaaaagttgtagaattacatgtttaaaggaatgaaacaagagaacgttaacaagaaaatctataaccaaaaaggctctcaaaaatgaaggagaaataatgacatttgaaaaaaataaaaactgctaaaatgcatcactatctgaactgtcttacaagaaaaattaaaatgagtcctttgggctgaaatggaaaagcatgatgcagcaattcaaatccacataaataaagagtaccagtaaagcagctacctaggtgaacatgaagagaaccaaaaatgtacattttaactgttttattttcctatataatttttaaactgcaaaaacagtaattataagacatttctgaatagtttacaacgtataaatataacatttaataataaaatgctactataaaaatgaggagggaatgaaagcacattgctgcaaatattctgtctgttttggaaattaagttagtattaatctgaactagaatgttgaagtaagaagctaattgtaatccacagcattacaaataagaaaatatctcaaaaatatattaaaagagacaacagaggaattaaaattgtacactagaaagtatttaacaaaaaaaatgaggcagtaatgaaaggaaagaacaaatatataaggcgtacagcaaacaaatagcaaaatgacaagaataagttctgccttgtcagtaataacatcaaatataaatggaataaacactccaattaaataacaggtattgctagatggatgaaaattattattcaagagacatattttaggtacagaggcacaaaacaaatgaaagtaaaataaaaggatggcaaaatatataatatggaagcagttatgaaaattgagctggagtggctaacctcatatcataccaaatagacaacataaaaattgttacagaggtaaatgaatacttttatagtcatatagtagtccatattaataaaaaaatatgaaaatatttgtacctaacagattctcaaaatacatggaaaaaatggcagaattgaagggataagtatatacttcaaaaataatagttggagtctttaattctctgctttcagtaatggatataacaacaaagcagcatatcagcaaagatataaaatactcgagcaagaccagaagccaactaagcctcactaacatctatagaacactgcacccaacaaagaccatataaatgaaatagaaaatacaaagacaacagaaaaaagttctcaaaaccaaatgttgattctttgaaaagatcagcaaattgacaaaactttatatagactaaccaagaacaaaaagagagaagacaggttactaaaatcaagaataatagagagcacataactaccagccttaacgaaataagggttataaggaattctatgaattaaaaagttagattattcaaatgaaatgaacaaattcctagaatgacccaaaccataaactgaagaagaattataaaatatgaatagaactacaataagagattgaatgtgtgactaaaaaaaaaaattgtaaaaagaaaatcctaggcccaaaaagcttcattggtgagttttactaaacacataaaaaattaataccaacttttcacaaactctttcacaaaataaaagaggaagaaacatttcccaactaattttaaagaccatcttgctctgatatcaaaaaacaaagacaatgcgagataaaaattccacagaccaatattccttatgaatattgataaaaatatccttgatgaaatactagaaaagtgaattcagcaaaataaaaaaataatcacacataataaccaaatgagatttacccaggaatgcaaagctaaacctaacattctgaaatcaattaatgtaaaaacatataaacggaataaaggacaaaatccactaagtatcccaatagaaaaagaatatatattttacaaaattcaacatgctttttatagtaaaaccactcaataaactaaaaatagaatggaacaccttcaacctgataaagaacagctatgttaaactgacgaccaccatcaaatttaatggtgaaagatagggcttttcctctaagctcaggaacagaacgaggatattcattcttgccacttgtatttaaccttatacttgaggttctagccagagaaattagataagaaaaaaataaataaaatgcaaccatacagcaaagaaagaaatacaaatatttgctgacggcaggatcttatatagacatacctcagagatattgtgggttcaattccaaaccacagtaataaagtaaatattgcaacaaagtgagtcatgaacattttggttttccagtgcatataaaagttaaatttacactatactataatctattaagtgtgcaatagcatttagtctaaaaaacgtgcatgccttaattaaaaaaatactttactgctataaaaatgctaataatgtaagcatatactgttgggaaaatggtgcctatccaatttgtccatacagcattaccacaaaacttcaattggttaaaaaaaaaaaaaaaagatatcttcaaagcacaataaagcagaacataataaaatgaggtatccctgtatatagaaaaccctaaaaaacacactaaaaactgttagaatgaaaaacaaattcagcaaggttgcaagctaaatatcagtgaacaaaaaatcactgtatttttatattttagcaatgcacaatccaacaaataaaattagagaataaattcattcacaatagtgcaaagaagaatatttgtgcatatatttaacgagagaagcaagacttttatactaaatactacaaaaattgttgaaagacatgaaagaatatgtaaataaatgatagatatcctttttttcatcaattagaaggcaacattttcaagaggcaaatacactccagactgatgcacttattcaagcagtaccttgcaaaatcgaatgtggctatttttaattgctaaaattgacaagttgatgccaaaaatttatattaacatatatgatgcaagggaaccaaaacagccaaaacaatttggaaaaaaaattagatgatacctacttcctaatttaaagtgtatttcaaagctacagtaattacatagcatggtactggtggcataaagatggacataagattaattgaataaaattgagtccataaatatagttttacatatatagacatttgatttgagtgtgggggagtcaagaggggaactgagcaaatttattgttttcttctttttaaaaatcttattttgagataagcataaattcacattcaagtatttaaaaaaacactttcatccattttctaattggatcattaaattttttaactgctaaatttgaaaggttgtatatattctagatgcaggtactcttctccagtttgtgatttccaaatattatctgatactcaatagctgttcttttcatattcttcatagggtgtatgacatagcaaaagtttttaatattgatgaatttcatgtcatcactttgtcctgttatggatcctgctttgctataaagactaattattgttcacctattcttagattttaaacattttttgtatctatttttctaaaagtgtaatagttttatgtttcacatttaagttgtgatctgtttatttaatttttgattatgtatcagacttaggtcaacattaattttgctttcctgtgcatgtccaaatgatccagcactatttagtaaaaaatctacatttccgtaaatgaaatgcttttatacctttctcaaaattagtttggcatacttgtttgagtctatctttgaggttctctattgtgttccaatgatctatgtttctacctctttgctaatgccaaagtcttgattattgtaactacataataagctttgaaatcaaccatactaaatcttcccacagtattattcatttttcaaaattatttattctagttcctttgtagtttgaaataaaatttaaaataatgttgtctacgtctacaaaaagtcttgttgaaatattgtcaagaatggcattaaatttataagtaaatttggggataattgctgtttcactacaagagactttcagtccatgagctcagcatgtctctccatttatatagatccccatcttgaacttcttctactagctttgtatagttttcaggatagaagtcctagacatgacttgttaaatttaatcctaagtattttatattttcttaatgagtgtaaatgataatttagatgtctacatgttcactgctactatacaaaaattacgatttttaactgatatttgctttgtatctgtaacccagttgaactcacttatgtagagtagtctttctgtacatctataaaattttctactttctgtcttaatcatctgtattattttatattattttagattcagggggtacatgtactgtatagccacttaca

SEQ ID NO: 6 - DNA, 17945 bp, Homo sapiens
aaaatcaatttagtcaacaagactcacaacctagaattttaagttcacatctcccagggccttttaatctattcttaccgagcttagaggaaaaattttcctttgctcttaaatatgtgcctcgaatgttagtcattaacttttataattgtttgctcctggtacaatttctacacactttgcaatactagagtttaagataactctgtactctaagaatactacatgttattttaaaacctttagaaaatacgcaagaatccaaagatgaaaaaaccacccataattccatcacacaacattaaccttgaaaattgcatctttatcctcctcatttaaaaatataaatatactttcttaatcctcctctctaaaactcatattgtaaataaaggagaaaaataaggcagatatctagtttaataatatttctgtagaacatttcagcagtgcaaaaacaaactaaaaatcaaactgaaataacaaagttatttggtattttaagtttctgagatcttggtttcatttttatgtatatatttcagttattttttgcagcataataaactaaaaaatttaatgactcaaaacagtaatgatttatgatttcttatgattctatagtttatatgaacagtttctctgctggttacacttggcctcacttatgtgcatttggctgagagagaggtttcaagatggcctcactcacatgcccgacagctagtgctggctgttgactgagtgcctcagttattctccacgtgactttctgtcttccatttggctagacttacatggtagtgtcagagacagcaatggcaaaagctgtaaggccttttgagaccgtggctgcagagctcatgcagcgtgactttcaccataatctaccagtcaaagcaagatacaaggccaggccttatttacaacaagagtaaaaggcatcccttttggattagagaatattaaaaaattttttgatcattaatctagcacaaagttgtaaaatgtatgaactacttactattaatgaaaaattgtgttccttttgggggaactttcttactatttgaacttatcaaatgatataaagaaataccaaacttattggggaaataagatcatgtttttctggcaaaagctgacattttcatatgaatgtatgtacaaattccaatgcctatgaagctacgatggtaacaaacatcactgaaatgagccaagtcaagattggagtaatctggaccatatatgctctatctgaaaatggaaaagtcgatggttctttttttttttggctgaataagtccagtgatgcctggaccactgatattttaaaacaaagattaaatattggtaagtaattttgttaaacaacatgaatctaaaagttacatggaaagacaagagacccagaatagagagcacaatactgaataagaagaacaaagtcaaaggatggacaccacctgacttcaagacttactataaagttacaacagtcaagatagtgtggtattggcaaaataatagatccatggaacagaggagagctccctaaaatagacccagacaaatacagtcaactgatctttgagcaaaatcaagtcagtggagaaaaaaatcgccttttcaacaagtggtactggaacaatagaatgtccatatacaaaaaaaaaaaaaaaaagaatccagacatacctttcacaaagattaactcaaaatggaccgtaaacctaaattcaaacacaaaattatgaaacttctagaggataatgtaggaaaaaatataggtaagcaaatttggcaatgcatttctaggtataacgtctaaataatcatgaaaggagaagttgataagttggactttattaaaattaaaaacttatcttctacaaaagatacttttaaaagagtaaaaaacaacccacagattgaaaaaaaatttgcaaaacacacttgtgatcaagggcttcaatccgaaacacacaacaaattattaaaaggaaagaaataaatttaaaaatagataaaagatctgaacagacacctcaccaaggaatatataaaaatggagagtaaacataagaatatgtttaacatatgtcattaggcaattgcaacttaaaacatctattatataccattacacgtgtattagaatggctaaaatacaaaaaaaataatggcaatagcaaatgctgacaaggatgtagaactttttttgctggtggcaatgaaaaattgtacagccacttcagaggacagtttggcagtttctcacaaagctaaacagttttaccatacaatctagctattgcactccaatatatttaattgagttgaaaatttatgtcctgataaaaatgtatgcttgaatgtttatagcagatttgtttataatcaccaaaaactggaagccaccaaggtattcttcaatagacgaatggataaactggtacatctagacaatggattattacccagcaataaaaataagtaacctatcaagccatgaaaatgcatgaaggaatcttaaatgtatattgctgtgagaaaaaagccagtctgaaaaggctatgtactttatgattctagtgatatgacatcctggaaaaggtacaactatagaaatagtaaaatgatcagtggttgcctggagtttggtagggatggcaggagtgtaatgaataggtgaagctcagggatttttaggatgctgagattattccaaatgatatggtaatacatatatatgacatgcatttgtcaaacccataggattatgaaaagtaaagggtgtaaataatgtcagctatggacttcagttaatgataatgtatcaatattggttcatgaattaaaacaactataccacattagtgtaagatgtttgtaataggagaaactgcattgcaagggatggggacctgatatatgaggatactctgaactatctatctgttcaactgttttgtaaataaaaaattttaaataaaatattaaataaccattttgtgttgcatgattttgttttctgataaaatagtttgagtggaaaacctcagctgggcttggtggctcacgcctgtaatcccagcactttgggaggcttaggtgggcagatcacctgagatgaggagttcgagaccagcctggccaacatggtgaaactccatctctactaaaaataccaaaatgagccaggtgtggtggtacatgactgtaatcccagctatttgagaggctgaggcaggagaatccgttgaacccaggaggtggaggttgcagtgagctgagatggcgccactgcactccagcctgggtgacagagaggctccatctcaaaaataaaaataataataataataataatatatataaatgaaaggaaaaagtgtcccttccatgggtaaattagtagcatcgttgataggtcctaggtaatttttttttcttttttagctagaagattaagtagatcttgatgtttttcacaggggatattgtagaacggtattgtatagtgtaagttgtagaaacatttctaccgaggagcagatggtaaaagtaaaatattcaaatgcataggcctctaatatcaaggcaactatttgtaaatatatattttgggaactttcgtgttcaggaaatttattattaagcagtattgtctttcaaaccatatttgcgagatttgaaaagtcactttgaagaaaggaaatgaagcataccatcagcaattttcaaaagttctgagacatttttctacagtattgatataataaagatgaacacatttggaaaatgttctcaatattttcattgtgaagagtatttatttttgttgctggaacaaccagaagcaaatgtgggaagactgagaaagtgtgaaattttatttctccacgcaaagaatactttagataacaattactgtctcaactactagcttgagaactggtgtcctttttattacactgtgatatacctgtgtggagttgggtcaggctaatgaagactaaagataatgtcaaatatgtcctatgtcccctcccactttatattctctttgaccaccagcagctcatgctatgacccgattgggtctgtcctcactcagcgattctcctcaccccgatcctagtttaaaagatttcattgcctcattttctttgcatccagattttgctttgagtctgcaaaatgacagattattggctaatcccactgaatgaatttggttgaagatgacttcaattaagtcttcctcaggagatgtggattttcatgggtacttgaaaacacagcatcttgtctcaaataaactttgagtgacataattttagtcaacaggtctggtcagaggatgttgccatgggtagaacaccctcctccaaggactggttttggtgtgtccccaggcattatcagtagagcttatataggaaggtaaatagaagctcttaactgtccgcaagcctacttgagcattgcatttggggcttagaactttgtgaattttttgcttattccacctgatataatcttagcaactttggatgaaatgcatttaaggattgaatcaaaagacttcctaagtcgcataaagactgtttcagttatctgctagtaaaagtgaatagtgttccatatatagaactagtaaatgcatcagatgaagtagaaggatgcagagaccttcactgacccagggtttcagctctaggggcaaactcactctttgaaatgttgttaaaattaaaaataaaaagccagacacagactagttataaaataaaccaacttcagttatataaatctgacttccttttctaagaaagcagttattttctcagcacctgtgtattctactcttcagtacctgtacgctatttaatacaatttgaatatgtcaaattctaatatatttgtttctcttattttccaagccacagaagcaataaacaatgtagaagaaagtagaatagatattggtggtaggcaaactgaacatatcaataagttttggacaataacatttagaaaagctattgacatttttctgttctctaatgctgataagtaaacaattcctgcttacttatgggtagcctcagatacatgaatagcctcaagctgatgccctataccatgatgtcatcaacagctaagaatatttcaatatcataatcctatacacttgggatgaaaaaaactattttaggagtttacaaatttcattggcatcttttcatttttctttccatcttttgttaggaaaaaaatcaaaatatatcatttatctttgcaatgtttttcatatatcatatgatactgtgttttcccctcatagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtatttcacatttaagacttttttgtaaagtgtacttttgtatggtatatgctgctatttatatttctctaatttgatataagtacctacagtactagggtttttcataataattgaatatttttccacatttcttggcatgatacagttatatgaaagatatttagccactgggatgagaagatgaggaaaagatcaaaatccatgggatcaattctgaaaggaaactgaggaagtcagggctgcctttgagatggtcctgtccaaagagtcttcagcagagaaattttggtggattccattataagaaagtggtatatagagaggtttgatccttaatattctgtgtcacacacaaaagataactatgtgaagtgatatgatcatcagttcaactgtgataatcatttcacaatgtatacatataccaaaacattacagtctacactgttattatatgcaatttttgtcaactgtacttcaataaagctaaggggaaaaatgaaactaaatttttctgaattcaaatatgtagcatgtcattatagagtttgagcaattttttttagcttcaactatatcgctcatattcccagctataacaaatatttaagggaagacagaataacttggctggctttgaattgctggaatattaatattaagatacagttagaaaataaactctcaatagaatggaatacttagtctttctgatgaaatggatcttacttaatttcattgatttttgaggactggtattctcctttttaacatatttatttttatagagaaggtaagtccatcaatcataaattaatctttaaatttcatttaccttaaatatttagataacaacaaggcatggcatatgatattacagtatttttgagaacattagaacacacaagaaatccagttaccatttcagcacatcaaggtgtgttctctgcgtatagccaagcactcttagtgcagtatcaaatatggttttgtacaaaggttactaaattggatttcaggacacaggacattgattttcacttcagagtaccacttctctagacctcgaggttctcaaatccaaaatgagagatttggactagattatctatcattttttttttagcactaaagttacttccaagtttaatctgcttcatttatttgatcgctacacacaatcttccaatgggagtagtttaccttgagtgaatttttggatcaataagtgagactttaatcaagcccttatgatacacagtttctttcaagtgtcttaatttgagctttggtggaggtcatttaaagctctgagtatcttgcttaatatatacatatgttaatttactctgcaccttccctatgtcttgcaggtctaaaaagtattctttattgggtggaagcaacttgcttatctccaatgtgacagatgatgacagtggaatgtatacctgtgttgtcacatataaaaatgagaatattagtgcctctgcagagctcacagtcttgggtaagttagtggctggagatgagtttatattgtacctttcaaagtatatcaccgcgacattttaatgctcatcactgaattgattcctatgtttattagtgtgaaattgcaaagtcccaatactccacacatgtccttgctttgctctgattaattgcataggggttatatgcaatgtttgaatacttattaattaaaatccagatatattatgctttagtctaattattccagtgatacagctgaaaagtaccaaaaattattaatggcagatgtgttgaataataaatatgatattacaaaatatctgggaaaataaatgaaggaaaattgtacaaaatatttatccttgaggggaaaaaggcagatgttatttgagatgacagggtttctgacattaaattcagtatgttggtaagatttttttattaacatgggaatactgtgagtgttgaaagtgaaccattaaaataaagtatatgtaaggaaaagttgcatagcaagaatataatttaaacagatttaaggaggattgaggggttcattatattccaaaaggcagggttacccatgtgtcattgcaaacaaataattcttctacatggcagttattcaaacaaacacatatttttatcacttactccagatttattttaaccagttttatttgaattatgtagtttggagaaagtgccttaacatttggatttcagttgctttttttctgtaacaacaaccaaacattgaatcttaggaatttttcctctggaataaatctttttgccttttaaagaatctcagaaaaatcatagtctatttaaaagttattaagtaaaaatgaaaatatatcatatgctgattatatttgctaagttataccatgatattattccatccattttgctttttgtcttcaaaggttattcagaaaacactttcatctgtggacatggtaataatgtatatcatgggttagataatgacgttgcttgttctttgatcaaatcataaacattaaaccaggaatgggcaaaagacttaaaccctggatttagaggtagtattatactaactaaaatattagctgcctttaaaatggcacagtttaattgagtcatatttcatattttggtgaaacaaagaatagagaactttcacatttgtagtatcaaaattcagtaacacaaaatggttatgatggaaattgtattgtgctgtatattactgattataaggcagatttggttatggaatacgctagaatttacactggtcataggtaaagcattacttgcatgaggtcaaattttatttcaaattaatgcacattattttgacatgtaatggttcgttgatatctgagataaacatatgcaaatactgatttctggggataaactaaattagtctctatatatatacacacacacatatacatatgtgtgtgtatatatacatatacatacacacacacacatatacgtgtgtgtgtatatatacatatacatatatacacacacatacatatgtgtgtatatatacgtatacatatatatgtatatataaacgtatatgatatatacactatatatggatatatatacatatatatggatatatattttgtaatttacacaattcacaaagaaaaaatgccagtatgagtatgccaatacatatatatacacatatatacacacatatatgtgtatatacacgtatatacgtgtatatacacgtatatacgtgtatatacacgtatatacgtgtatatatgtgtatatatacgtatatatgtgtatatatgtgtatatatacgtatatataggtgtatatgtacatatacacatatatgcacatatatacttatatgtacatatacacatatatgcacatatatacttatatgtgtgtatatatgtattggcatactcatactggcattttttctttgtgaattgtgtaaattacaaaatagatgctgtttgatacatataaaactatccaaagatgcacaagaaaatatttaataattatttccactacaggcagtgcatttctatacctctgaagtgaatacttttggtatcttggcatgttttattccataaacttctcatatttcattgatgcacatatgcccacataaagtttggtagtggtatgacacttggatgcttctttgatttttccttaggccagatgattagtctctattacaatacctctagtgaaccttgactagtgttattatgtaaaaaatattgaaaataagcatccaaaaaatgctccacattactaatcattagagaaatgtaaatgaaaaccacaatgagaaccaccatctcacaccagtcagaatgtctattactaaaaggtcaaaaaataacagatattgccggggttgtggagaaaagagaaagagaatgtttatacactgcttgtgggaatgtgacttagttcagccattgtggaaagcagtgtggtgattcctcaaataacttaaagtagaattactatttgacccaacaatcctgttattaggtatatactcaacggaatgtaaatcattctaccataaagatacatacatgcgtatgttcattgcagaactattcacaatagtaaaggtatggaatcaacctaaatgccaatcagtggtagactgaataaagaaaatatggtaaatatacaccatggaatactatgcagccagataaataacaagatcatggcctttgctgcaacatggatggagccattatcttaagtaaactaatacaggagcagatcaaatatggcattttcctatttataagtggaagctaaacattgagtacacatggacacaaagatgcaaagtgtgtccttaggtacttgatgtttagtttccaatgtgggacactggggcctactgagagtggagggtgggagaaggaagagaaccaaaaaactatcgagcactatgcttattacctggatgacaaaataatctgtacaccaagccccagtgagatgcaacttatctatataacaaacctgtacttgtacccctgaatctaaaataaaagtttaaaaaattgacaacataaattaacgtaatataatacagttaatatgcattagtaatttaatctatgtgtacacatgtatgtaaaacatgtacatatgcacacatgtgcgtgcatatttatatgtgtatatatgtacatatatgtggatagatatacacatagatatattagaaacagcatttactgagttcaaaccatgtgagacatttatttgttacagtatcctctgtgggaagtacgtaggtcgagcccattagataacaaccctcttgccttctgtgcttctgtaccaagtgagaaacaagaacagcagtaaggcatagggtaagtcaaacatcaccttaatttgttgaagaagctgccgttgaccatggtttgcatctgcatgggaggcacatgcccatctggacatgggcagtgtctatattggcaggatgtcactcaggtgtcagcttgtcccactgcttggtggctggtggcaatggagagcacttgctctctttggtcaggcctgttcccaagagagaattgtaggtgaaaggagtctcttcaaacttccaggctcattaagttatctgtcatgtatcctgatccaggctcccctcaaaccaagaaaaagtgggtactggggagtggtgaggtcagaagtcattccctcgaggagctgcctctctagggaagaaaatatcagtattgaggcagaagtattcaacatccacaccccaaccttaggtgctacttttaatcccgttttacaaacgaaggcattttagcacagaaagataagtggctatcccaaggggggatccagatccaaatccaggcatccgaccaaagagtcttaggcatatgctttactgtctgccctgtctgctccacacattcctattcatcgttttttattatttatttttaatcttactgaaacagctataaaaaaaagcaggtttatgtgatgtaaataagaacaattttaaattttagtttggttaataattagtcacttacataaaataaaatacgtgaccgtaatgtaatgatcttgacaaagcagaaaggctgacaggggagcagggaagaaaggaatacaagctgttctttgaaaatgaggttaaaacaactgccatacttcgaatctgtagacacagaggcaggtgaaaagtgtactcaatatcgggtattgcttattttttttactgtaacttcttgtttattcaaagtggtgtgccgtttgtataatcagaaaaataaatgtggaggtataaaagttgacatgtttatggtttaaaaatgagataaataaaaatgttaaaactcagaaaatattgagattatgctaacatacacataatccaaagacctggactttgcaaacacacacacacacacacacacacacacacacacacacacacacactcacgtttgttttctccatataagtgaaatgtatgctatattgtatcctcattttcacttcaggataaatcatggcatctttctttgtgtgtgcctgtgcacatgtctatcttctccagttctaatttttttttctttttgagacagggtcttgctctgttgtggccttgagttcgtggtgtcagatgatcctccattctcagcctcccaagtatcttggaccaaatttggctatttattttttctttcttttctttttcttttctttttttcttcttttttgtagagacagggtctggttatattgcccaggctgatctcaaactcctgggctgaagtgatcctgccaccttggcctcccaaggttctgggattacaggcatgagccatcgcacccaaccttcagctttatattgtggaacattatcatgtttcttagttttaattaagcgaggtgtggtggcttgcacctgtagtcccagctactcaggaatctgaaggaaaggatcttttgagcctaggagctctagtccatcctggggaacatagcaagatcctgtatctacaaaaacaaaaacaacccactaagttaattatccttaagtatctttgtcatttatttgctcatatctgaaggaaaagtatcccagaaatacttaaaccctcactggcagagcaaaactttgcctcccttcagagtgcattttcccccacaattttgaatatctaaacattttataaaatggagtctccttgtaagtatttatattcctattaaattaagatttcattttatagttttcttggacatttgcattttacattttgtgaatttgctgtcttttttgaccttcatacatttattgaaacatttatccttattttattgattacagaaactctttatgtaagaataatattgactatgttgtgtatgcctttgcatttttacattttgcatatggcaccaaatctttttcttcatggttgctagcattgtcattagacttacatttttattctatgaaccatgctatctctaaaaatctggttatggattacatgttgaatgtttaaattagaagcatgattaatttctaaaaaatagtgatatgtttatattttgagttttcatggtcttggttctttttgtctgtttttaagggattttttttggtaattggacatattttaaaggtctctcatggactttatatcatttataactactctagaaggcataatttacttcaggatttggttgatatgctgttttaattattctaaaaggctccaaaaatgaatatttgtataatgtttgaaataatctttgactactctgatataaagttaggattatcctgcaggactgagtttatatgaaaaattgaatttattgccttcttaaaatggatgataagaaaagaactttattatcaatgttatttaaatttacttttcataatttttaagaatttaatcatatttgtattcttcataagataaaatcccacaagaaatccaagcttctgcttataaaactttaatcacgcattttattagactcttgttttgcctttcaacttgcagtcctttcttgtacttaactgtctgtgaatgtgaaccttcatgaactaacagacttttcaagtagaatatcattttatagactagaagaaaagacattttgttgccctcctcagtaattttacagagtgaatatacattaaatataatttgaagcttagcattttgtttccttcttataaaataaaaatggaaaattccataatcattaagctttttggagatatctttattagacaagattaatgacaaccttatttacaataaataaaatataaataagttcataggtattttctttatcatagccatttatggtagcatttctgacttacagtaatcatcgataaagtattggtggacaccttttgggtacaaggattgcactaggttctgggaagactacagaaacatctgaaacctggcttcagtgggcttcgtataattacaattcgtaaaatcagttggcctaatactgtctgaataaacttttatttaaaaaaagaaaaaacgaaaatgttatatgtaaacagggactctgggaagatatgaagagttggtagtctccactctcatagaaaacaaagcccgaagaggcaggggtgggaggagtcctaaagaagaaaatgtggaaggaggctcttggaatattgttgtcaactttttaatttaattttagccatgactacttgtattatttattttaaaacctaacttttataaaagaagtcaaaagtggtatttttccattcttatgttcaatacgtccagctttctggctcaaggattttaatctgactataattgtgaacatatccttttctgtatctgcccatccccaacttttacccagctccacacaggaagaaagacagtcctccataaatgttctagagatttgccactgctttgggtctagattgatcccatgtctgaatcagtgcagaaatgcataatttaaaaagtgatttgatcttttacaaagtgccaggctttggacaaaccttgtgtactgtccttacacacacaggtggagatgagtgggaactttactgaggatggtctcttcagtaggagccattaagttgaacatcagtgagaaaataaaaatatctttgaactttccagaaatggttctagaattccctttaaagcagttgtgtagcaacacaaaaaacttgtaattgccctctaggaatgtgttaagtagagttctctctatagagctgagcatgtccaccttacacagatgtgttcaataagcctgaagatgatagactcagaatatttatatatagatatagatatacatacacacgtatatttttgtatatgtgcatacatatacataaacatagtatatacatatatatgcaatacatgcacttactctctatttctaaagtttccctttaaacttattattttctttcaaatgcatatgattatctcaaccattaaatgaggttctgattctgcaaatagataatagactaagctattcagaaaggtctagaaaaatcatcttaaaagtgatttaagaagaggccaaataaagatatatgggtgaagttaaatacccctgttaaacattattgttttgtaagatagctggaaaagttcaccttaatagctcattgctcaaaatgctttggaaattttgaaacatatggctggatatacggtgagctaatgaatatagtttctagtcctagatatgcagctgaaccacagtgtgagtagaaaactagcaaccaactgttgagtgcctcttgtgtactaagcattccgccaagtagtctttgggcataagaagatatgacacagatccaagcctcaaggataggtagggaaaaagacaagaagcaggcaattgctaacaaggccgaagagctgttgagaaagaggaagacaagggaccctgaataaagaatgcaacaaagatgagagaatgggggagggagtggtgaggggagagtatgagaatgggggagggagtgttgaggggagagtatctgacaggaggtagtaaatgtgcaaaggtctggaaataagcgggatggggaacgggaagtgaattatgtgactaaagattgtgggtacaaaggaatctgatgctggatgggagaatccatataggtcttgagtattttgctcatgtggttagatttatcttaagggcagtggaaacatatggaaagatttctgattgtggcttgtgagctatttaattttagccagctatgtaaacctctaatcttcaattccttcattattttcttcatatttgtagagctttaggagctacaagtgcagttttgttacctggatatttcccatcatggtgaagtctgggcttttagtataacatcacctggatagtgtacatcgcacctattaagtaatttcttattcgtttgtaaaacaatgataattactttatcataggatttggtgtccgtttgagtgtgaaaagtagaggagagagattccagaataatcaggcacagctttgggtgttctgggaaataaagtaatataagatcccctcctagccttcatgagaagcctaaagccagttggaaagattaagctagctaaacaaaccaagacatcccaaatgtcacaaatattaaaatattctatgtactttttcatatccaattatcattatctataaaatgtacataacagcaactagtccctacgtagttctcatgaattatggcgcgattgatataacaatatctagtgatcaatataacagtatctagtgatcaatataacaatatctagtgatcaatataacaatatctagtgatacattgaaatttctttggcagtaatctctagaaacatagacatccctctgtgggaaaaagatgatgtccatttgtgatgtgttttatgtatttcacttttttctgtgcttctacaccttgctgttcatgctttcttcacagctagatagggagaaacttaaaaacagaagccatgtcttctacattttgatcactcaaacccttagatttttatctatgttatctgagttttaagcataagaaatgcaattgaatgtgcataaaatataaattatctaacttcctatcgaaatgttttgtaagctttccattgagattcatgattttttcattgaccactgcaatggacagaattatgtcctttcgaaattcatatgttgaaatcctaacccccaatgtgactgtatttggagaaaggcctttctttaaatgagtaactaaaattaaatgatgtcataatgaggggatgcctatccaataggaataatgcccttttaagaagaagagttactggagcactctctccacccttgcacagagagaaaaggccatgtgagaacagagaaggtgttgtctggaagccagggagaggacccttactagaagccaactttgctggtaccttgatcttgaacttcctaatctccagagctataagaaagtacatttgtgtgtctaagccacccagtctgttgtattttgttatggcagtctaagaagactaacacaactacagaaaaggtagatgctgtatgcgttacagaacaatcactaaaaatagaacaactgctaaaaagattctttggtcttttttatcaaaagtgagcaacaatgaagacttatattatcaacattgcttacatattggtagcacaaataatcttagatttctaggagtgtaaaaaattcccatttacaatagcagtggatcaaaaataattgctcatttacataataggtcttgtgtagttcttagatccttataaatttgatgtcctttcatcttatttttgttcgctatcatccctttatttaataattactaagtgtaaggtatgatatatattttaggtcttatatttataaatgacctatatcaatttaatagtaaatatatcattaactgtgatgaaattgtattcttttttaaatcaattctcagatatgctctatgaattcaatttactacaaacaagcatgtatatcttcacacaccatcaattcagatttgtttggaaatggaagaaaacatatacttcaaaattgatatggcttttttccttttattttttgcataggctttaattttattttttacggaacaatatgtgatattagctgctattttttgagcatgtattattggccaaattttacctatccatttgcttgaggttagtggttcatctacctcagacttgggtgttcagtctcttcctacttcagcttgctggtagatcaaccatgttgagttttaggtttaggctctttgccataaatgggaagtagttataataaaatatgttaagataatatttatctttttattgcaatgtgtaattcttattttgaatggagttcttttgaatttacaacatcattgcctctgcctacgtagcagtccttaaattttacatatatctgtaattgcccttattaacaggactcctcagtcatatacatttaatgataatagtcataaaagaagtgccttaggtacgtttgtattgattatcctctacaatgtaattaccaaatgaatcatactgaaatgagttaagagagtttttgtatgtagggttttgatcctaaatgtaggatacaggtgtgtaatataaggcagaattaaatcaagaaaactattaaatcccacctattaggtgcttcttcccattgctatgcagattacttatcttagttattttcctcagctgaaactctggttgtcaaaaggtatgcaaaattaagtgcaaaatatgtttaaaagattctgttgaatatttatatgaattagaagaagaga

SEQ ID NO: 7 - DNA, 22064 bp, Homo sapiens
cacttccttcagacttgctacaaaatgaatctgatagacttaaaatttgctgtgagacacaaggggtagaagccatacgccagtgataagaatagatgatttcctttcttccgccagactctaactagaaatagcaatatgtatgtgtacatagagaaagaaagaggaaatatgaacagatgtaggaatatttacagagagggaatgtcatttttagtactgaattggtgtaaatgaggaaggaaaataatagaatcctagagtggtgaataatagctccggagaaatggcttctttctccctccatgtccaaaagctccttggcttacagccagatggaagttttcatttttttattaaataaattctggttcccgtgatcagtttggattaggctggtttttcaataaagaatattctaaacacagagttaggagtttcatggaatttttcactcagagcacatagtagagtacctactggtgtttgaaggctcacggtacctgctgaatattctaaaacagaactagatgcgggatggctaagcagccagcaggtgaacagtaggttagcttgaaattgaggatgcagacagagcaaactagctctctgaagttaaattaatttgtaactcttatgcctgggaagaaatcaaagaaaataccccacagtagcctgcagtgccctttcatttccatttggaaatgtgtttgatattccatggaggcaggaatttaataaagaaaaccgaggagtacacaatgaggaaaaaaggcttttgcattcagaaagcataaaaattaaaagcaactactggttattttgaggaagacagttattaagttgtgaaaactggtatttttttcttgccaacgcagatgtcaacagtccataatttaatttctctgtgtctcagttattctttagattcagtgccgtaaatttcatgttgaggttcctaaataactgtttagggaaatggccctgttaaaggaaagccgtagtcatcactgcattagcataaattcttgtttactcaggatacatttgatcacatccagtgtcctaaaataattgtaaggagtgtttagggtcccaggttggataatttatatgaccaacctagtcatctaccatgagggaagataaaatagtgtggccccaaagacatttgggaaaatctgtgaatatggacagtgaatatgcccctcagtatgtcacacacactcaattaatttgaccattgtaatgttttaaccttttttaaaacaattctttaaaaaggaaatattctcttcctttaatacatcttcccttctttagggcatggggcctgatgatagttgactttttgtttctgaatatattaagtgtaaataaatgtgtcaggttatatgatccatgatgctatttgacttttaacaaattattgctgaaatatagtaattgaacatatttaattttgcactatcttctcaaaggcaaaataagaggggcaagagaggcagaaaagaggaaggaaggaaaaggggactgaaagagggaaaaagaagaaatatatttatcaatttctatttgagagatacaaaaccatttctatgttgaaggaaaatgggcttcttgagtatttcagaaacatgattaattttatgagactgtgtctgcatttgttctcaaagtatggtagatacctagaactttggaatttcttgagatgctttcaggggatctgcgaggtcaaagatttattttaataataatatatatcttttgagttttttaccatgttggcttaagaatgtccatgaaaaagcagtgaaaattattaattttattgtctcgatccttaaagtacacatctttttagtattccacatgtgtcaacataggaaaatacatacgcaaaaataaaagtataatgggttttgcatggtaaacacttctgaggtcatttgtgtttcaagctgaattagctaccttttttttttttttcttcatgaaacaccatttttacttgaaaggacagtcaatagaaaaacttgctgttcacacttggatacttgttacacatttctcaaaaatgaacaaagtgagccagctacttcaaggaaaataatatttacttccaagaatgaaattcaagtttttaagttagaaatttgcaaaacatgtatctgccactgggagcttgacagcttcccaacattcaagcacctttctgatgggattggtggtgagagtagcaaatgagactttttgctaatctataaatgtttcaacatttggaagatgtgtctaatacaatgtaccaatccaaataaccagtgattgatgtgacagaatcatgcatgggtaaaagatctattcaaaataccagctagatcagtagatttttacataacatagcacaaaacgtttataaatatggtgctagatttcacattacaactaattttcaaaaccctgcttattgagttttgctgaagtgttcaaggatatctctacaattatgtgaaaaggctatcaaagtacacctcccttttccaactacatgtttgtttgagatcagattgtttctatgtaattcgaccaaaacaacataacagaacaatgtcaatgcagaaagtatttttaaattaaaccaataatttttaagatttataaaaatggaaagaactaccactatactcaataataattttgttttggccgacataggtgtttttttaaaaatattatttttgatggggtaaaaataaatatttaatagactgggcacagtggctcatgcccataatcccagcaacttgggaggctgagacaggcagattgcttgagctcaagagtttgagaccagcctgggcagtctggtgaaaccccgtctcaaaaaaaaaaaaaaagaaaacaaaaaaaaaaaaacaagaaaaaaataaaaaatattggctggacgtagtgacatgtgcctgtagtcccagctatttgggaggctgaggtggaagatggcttgagccagggaggtggaggttgcagtgagctgagatcatgccactgcaacccagcctgggcaacagagcgagacagactctgtttcaaaaagaatcaatatttaatgaacaaatattttaaaaatctgttttgatttttagtatggaatgtatttgttgctatatcctgtataatcaaaagctaaagagcttcaaggggatattcaataattttcaaaagcacaaaagttcctgagacccaacagtttgggattcactgtctgcatcgttattctttgttgtaatgattgtagactggtcatcctcaactcaggtaacagattaagctaaagtaggtcaatatttctatttagaaaaaagtgaagaggaaagagagaaaggaaaggatagcaaaggcaacgtattgccatagggtggttccacattttaaggcaccctgtgtagcctgagatcagtatcactgtaatgactgttttctctttatttccataccaccctcttgctgtctgggaggattatctgtactgccaccaggataacaaacagaccagttcaaagaatcaggttaacattttctccccaatagggaaatgctaaactaggcttgagttcaagtaaagcattactgcttttaatcgatttagaaaaatagttacataactttgtacatttacgttcatgagcatcacattaaagaggtatgcttttgtagattttaataccaaaatttgacattagaaaaaaatccatttttttctgctggcttgaataaaactattgtcaaatatgttttctaggacccacgcttatatttttctctcagttttattttaaaatatgccatagatacatataagtacatgaaatatatgtatatcttagagaataaaatggaaaatgaccatgtatgtgtcaaccaatttatgaaatagaacattacaaatttgcattctgataccctctcctgtaattgaactatgttcattaatttactggaaaagtctttatattctattagctgaataattgcatttggatatgaatagtggtgcccatataacgagaacacaaatgatttttaatcagtaattactaatttcatcatggttccattaaaatcaatttagtcaacaagactcacaacctagaattttaagttcacatctcccagggccttttaatctattcttaccgagcttagaggaaaaattttcctttgctcttaaatatgtgcctcgaatgttagtcattaacttttataattgtttgctcctggtacaatttctacacactttgcaatactagagtttaagataactctgtactctaagaatactacatgttattttaaaacctttagaaaatacgcaagaatccaaagatgaaaaaaccacccataattccatcacacaacattaaccttgaaaattgcatctttatcctcctcatttaaaaatataaatatactttcttaatcctcctctctaaaactcatattgtaaataaaggagaaaaataaggcagatatctagtttaataatatttctgtagaacatttcagcagtgcaaaaacaaactaaaaatcaaactgaaataacaaagttatttggtattttaagtttctgagatcttggtttcatttttatgtatatatttcagttattttttgcagcataataaactaaaaaatttaatgactcaaaacagtaatgatttatgatttcttatgattctatagtttatatgaacagtttctctgctggttacacttggcctcacttatgtgcatttggctgagagagaggtttcaagatggcctcactcacatgcccgacagctagtgctggctgttgactgagtgcctcagttattctccacgtgactttctgtcttccatttggctagacttacatggtagtgtcagagacagcaatggcaaaagctgtaaggccttttgagaccgtggctgcagagctcatgcagcgtgactttcaccataatctaccagtcaaagcaagatacaaggccaggccttatttacaacaagagtaaaaggcatcccttttggattagagaatattaaaaaattttttgatcattaatctagcacaaagttgtaaaatgtatgaactacttactattaatgaaaaattgtgttccttttgggggaactttcttactatttgaacttatcaaatgatataaagaaataccaaacttattggggaaataagatcatgtttttctggcaaaagctgacattttcatatgaatgtatgtacaaattccaatgcctatgaagctacgatggtaacaaacatcactgaaatgagccaagtcaagattggagtaatctggaccatatatgctctatctgaaaatggaaaagtcgatggttctttttttttttggctgaataagtccagtgatgcctggaccactgatattttaaaacaaagattaaatattggtaagtaattttgttaaacaacatgaatctaaaagttacatggaaagacaagagacccagaatagagagcacaatactgaataagaagaacaaagtcaaaggatggacaccacctgacttcaagacttactataaagttacaacagtcaagatagtgtggtattggcaaaataatagatccatggaacagaggagagctccctaaaatagacccagacaaatacagtcaactgatctttgagcaaaatcaagtcagtggagaaaaaaatcgccttttcaacaagtggtactggaacaatagaatgtccatatacaaaaaaaaaaaaaaaaagaatccagacatacctttcacaaagattaactcaaaatggaccgtaaacctaaattcaaacacaaaattatgaaacttctagaggataatgtaggaaaaaatataggtaagcaaatttggcaatgcatttctaggtataacgtctaaataatcatgaaaggagaagttgataagttggactttattaaaattaaaaacttatcttctacaaaagatacttttaaaagagtaaaaaacaacccacagattgaaaaaaaatttgcaaaacacacttgtgatcaagggcttcaatccgaaacacacaacaaattattaaaaggaaagaaataaatttaaaaatagataaaagatctgaacagacacctcaccaaggaatatataaaaatggagagtaaacataagaatatgtttaacatatgtcattaggcaattgcaacttaaaacatctattatataccattacacgtgtattagaatggctaaaatacaaaaaaaataatggcaatagcaaatgctgacaaggatgtagaactttttttgctggtggcaatgaaaaattgtacagccacttcagaggacagtttggcagtttctcacaaagctaaacagttttaccatacaatctagctattgcactccaatatatttaattgagttgaaaatttatgtcctgataaaaatgtatgcttgaatgtttatagcagatttgtttataatcaccaaaaactggaagccaccaaggtattcttcaatagacgaatggataaactggtacatctagacaatggattattacccagcaataaaaataagtaacctatcaagccatgaaaatgcatgaaggaatcttaaatgtatattgctgtgagaaaaaagccagtctgaaaaggctatgtactttatgattctagtgatatgacatcctggaaaaggtacaactatagaaatagtaaaatgatcagtggttgcctggagtttggtagggatggcaggagtgtaatgaataggtgaagctcagggatttttaggatgctgagattattccaaatgatatggtaatacatatatatgacatgcatttgtcaaacccataggattatgaaaagtaaagggtgtaaataatgtcagctatggacttcagttaatgataatgtatcaatattggttcatgaattaaaacaactataccacattagtgtaagatgtttgtaataggagaaactgcattgcaagggatggggacctgatatatgaggatactctgaactatctatctgttcaactgttttgtaaataaaaaattttaaataaaatattaaataaccattttgtgttgcatgattttgttttctgataaaatagtttgagtggaaaacctcagctgggcttggtggctcacgcctgtaatcccagcactttgggaggcttaggtgggcagatcacctgagatgaggagttcgagaccagcctggccaacatggtgaaactccatctctactaaaaataccaaaatgagccaggtgtggtggtacatgactgtaatcccagctatttgagaggctgaggcaggagaatccgttgaacccaggaggtggaggttgcagtgagctgagatggcgccactgcactccagcctgggtgacagagaggctccatctcaaaaataaaaataataataataataataatatatataaatgaaaggaaaaagtgtcccttccatgggtaaattagtagcatcgttgataggtcctaggtaatttttttttcttttttagctagaagattaagtagatcttgatgtttttcacaggggatattgtagaacggtattgtatagtgtaagttgtagaaacatttctaccgaggagcagatggtaaaagtaaaatattcaaatgcataggcctctaatatcaaggcaactatttgtaaatatatattttgggaactttcgtgttcaggaaatttattattaagcagtattgtctttcaaaccatatttgcgagatttgaaaagtcactttgaagaaaggaaatgaagcataccatcagcaattttcaaaagttctgagacatttttctacagtattgatataataaagatgaacacatttggaaaatgttctcaatattttcattgtgaagagtatttatttttgttgctggaacaaccagaagcaaatgtgggaagactgagaaagtgtgaaattttatttctccacgcaaagaatactttagataacaattactgtctcaactactagcttgagaactggtgtcctttttattacactgtgatatacctgtgtggagttgggtcaggctaatgaagactaaagataatgtcaaatatgtcctatgtcccctcccactttatattctctttgaccaccagcagctcatgctatgacccgattgggtctgtcctcactcagcgattctcctcaccccgatcctagtttaaaagatttcattgcctcattttctttgcatccagattttgctttgagtctgcaaaatgacagattattggctaatcccactgaatgaatttggttgaagatgacttcaattaagtcttcctcaggagatgtggattttcatgggtacttgaaaacacagcatcttgtctcaaataaactttgagtgacataattttagtcaacaggtctggtcagaggatgttgccatgggtagaacaccctcctccaaggactggttttggtgtgtccccaggcattatcagtagagcttatataggaaggtaaatagaagctcttaactgtccgcaagcctacttgagcattgcatttggggcttagaactttgtgaattttttgcttattccacctgatataatcttagcaactttggatgaaatgcatttaaggattgaatcaaaagacttcctaagtcgcataaagactgtttcagttatctgctagtaaaagtgaatagtgttccatatatagaactagtaaatgcatcagatgaagtagaaggatgcagagaccttcactgacccagggtttcagctctaggggcaaactcactctttgaaatgttgttaaaattaaaaataaaaagccagacacagactagttataaaataaaccaacttcagttatataaatctgacttccttttctaagaaagcagttattttctcagcacctgtgtattctactcttcagtacctgtacgctatttaatacaatttgaatatgtcaaattctaatatatttgtttctcttattttccaagccacagaagcaataaacaatgtagaagaaagtagaatagatattggtggtaggcaaactgaacatatcaataagttttggacaataacatttagaaaagctattgacatttttctgttctctaatgctgataagtaaacaattcctgcttacttatgggtagcctcagatacatgaatagcctcaagctgatgccctataccatgatgtcatcaacagctaagaatatttcaatatcataatcctatacacttgggatgaaaaaaactattttaggagtttacaaatttcattggcatcttttcatttttctttccatcttttgttaggaaaaaaatcaaaatatatcatttatctttgcaatgtttttcatatatcatatgatactgtgttttcccctcatagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtatttcacatttaagacttttttgtaaagtgtacttttgtatggtatatgctgctatttatatttctctaatttgatataagtacctacagtactagggtttttcataataattgaatatttttccacatttcttggcatgatacagttatatgaaagatatttagccactgggatgagaagatgaggaaaagatcaaaatccatgggatcaattctgaaaggaaactgaggaagtcagggctgcctttgagatggtcctgtccaaagagtcttcagcagagaaattttggtggattccattataagaaagtggtatatagagaggtttgatccttaatattctgtgtcacacacaaaagataactatgtgaagtgatatgatcatcagttcaactgtgataatcatttcacaatgtatacatataccaaaacattacagtctacactgttattatatgcaatttttgtcaactgtacttcaataaagctaaggggaaaaatgaaactaaatttttctgaattcaaatatgtagcatgtcattatagagtttgagcaattttttttagcttcaactatatcgctcatattcccagctataacaaatatttaagggaagacagaataacttggctggctttgaattgctggaatattaatattaagatacagttagaaaataaactctcaatagaatggaatacttagtctttctgatgaaatggatcttacttaatttcattgatttttgaggactggtattctcctttttaacatatttatttttatagagaaggtaagtccatcaatcataaattaatctttaaatttcatttaccttaaatatttagataacaacaaggcatggcatatgatattacagtatttttgagaacattagaacacacaagaaatccagttaccatttcagcacatcaaggtgtgttctctgcgtatagccaagcactcttagtgcagtatcaaatatggttttgtacaaaggttactaaattggatttcaggacacaggacattgattttcacttcagagtaccacttctctagacctcgaggttctcaaatccaaaatgagagatttggactagattatctatcattttttttttagcactaaagttacttccaagtttaatctgcttcatttatttgatcgctacacacaatcttccaatgggagtagtttaccttgagtgaatttttggatcaataagtgagactttaatcaagcccttatgatacacagtttctttcaagtgtcttaatttgagctttggtggaggtcatttaaagctctgagtatcttgcttaatatatacatatgttaatttactctgcaccttccctatgtcttgcaggtctaaaaagtattctttattgggtggaagcaacttgcttatctccaatgtgacagatgatgacagtggaatgtatacctgtgttgtcacatataaaaatgagaatattagtgcctctgcagagctcacagtcttgggtaagttagtggctggagatgagtttatattgtacctttcaaagtatatcaccgcgacattttaatgctcatcactgaattgattcctatgtttattagtgtgaaattgcaaagtcccaatactccacacatgtccttgctttgctctgattaattgcataggggttatatgcaatgtttgaatacttattaattaaaatccagatatattatgctttagtctaattattccagtgatacagctgaaaagtaccaaaaattattaatggcagatgtgttgaataataaatatgatattacaaaatatctgggaaaataaatgaaggaaaattgtacaaaatatttatccttgaggggaaaaaggcagatgttatttgagatgacagggtttctgacattaaattcagtatgttggtaagatttttttattaacatgggaatactgtgagtgttgaaagtgaaccattaaaataaagtatatgtaaggaaaagttgcatagcaagaatataatttaaacagatttaaggaggattgaggggttcattatattccaaaaggcagggttacccatgtgtcattgcaaacaaataattcttctacatggcagttattcaaacaaacacatatttttatcacttactccagatttattttaaccagttttatttgaattatgtagtttggagaaagtgccttaacatttggatttcagttgctttttttctgtaacaacaaccaaacattgaatcttaggaatttttcctctggaataaatctttttgccttttaaagaatctcagaaaaatcatagtctatttaaaagttattaagtaaaaatgaaaatatatcatatgctgattatatttgctaagttataccatgatattattccatccattttgctttttgtcttcaaaggttattcagaaaacactttcatctgtggacatggtaataatgtatatcatgggttagataatgacgttgcttgttctttgatcaaatcataaacattaaaccaggaatgggcaaaagacttaaaccctggatttagaggtagtattatactaactaaaatattagctgcctttaaaatggcacagtttaattgagtcatatttcatattttggtgaaacaaagaatagagaactttcacatttgtagtatcaaaattcagtaacacaaaatggttatgatggaaattgtattgtgctgtatattactgattataaggcagatttggttatggaatacgctagaatttacactggtcataggtaaagcattacttgcatgaggtcaaattttatttcaaattaatgcacattattttgacatgtaatggttcgttgatatctgagataaacatatgcaaatactgatttctggggataaactaaattagtctctatatatatacacacacacatatacatatgtgtgtgtatatatacatatacatacacacacacacatatacgtgtgtgtgtatatatacatatacatatatacacacacatacatatgtgtgtatatatacgtatacatatatatgtatatataaacgtatatgatatatacactatatatggatatatatacatatatatggatatatattttgtaatttacacaattcacaaagaaaaaatgccagtatgagtatgccaatacatatatatacacatatatacacacatatatgtgtatatacacgtatatacgtgtatatacacgtatatacgtgtatatacacgtatatacgtgtatatatgtgtatatatacgtatatatgtgtatatatgtgtatatatacgtatatataggtgtatatgtacatatacacatatatgcacatatatacttatatgtacatatacacatatatgcacatatatacttatatgtgtgtatatatgtattggcatactcatactggcattttttctttgtgaattgtgtaaattacaaaatagatgctgtttgatacatataaaactatccaaagatgcacaagaaaatatttaataattatttccactacaggcagtgcatttctatacctctgaagtgaatacttttggtatcttggcatgttttattccataaacttctcatatttcattgatgcacatatgcccacataaagtttggtagtggtatgacacttggatgcttctttgatttttccttaggccagatgattagtctctattacaatacctctagtgaaccttgactagtgttattatgtaaaaaatattgaaaataagcatccaaaaaatgctccacattactaatcattagagaaatgtaaatgaaaaccacaatgagaaccaccatctcacaccagtcagaatgtctattactaaaaggtcaaaaaataacagatattgccggggttgtggagaaaagagaaagagaatgtttatacactgcttgtgggaatgtgacttagttcagccattgtggaaagcagtgtggtgattcctcaaataacttaaagtagaattactatttgacccaacaatcctgttattaggtatatactcaacggaatgtaaatcattctaccataaagatacatacatgcgtatgttcattgcagaactattcacaatagtaaaggtatggaatcaacctaaatgccaatcagtggtagactgaataaagaaaatatggtaaatatacaccatggaatactatgcagccagataaataacaagatcatggcctttgctgcaacatggatggagccattatcttaagtaaactaatacaggagcagatcaaatatggcattttcctatttataagtggaagctaaacattgagtacacatggacacaaagatgcaaagtgtgtccttaggtacttgatgtttagtttccaatgtgggacactggggcctactgagagtggagggtgggagaaggaagagaaccaaaaaactatcgagcactatgcttattacctggatgacaaaataatctgtacaccaagccccagtgagatgcaacttatctatataacaaacctgtacttgtacccctgaatctaaaataaaagtttaaaaaattgacaacataaattaacgtaatataatacagttaatatgcattagtaatttaatctatgtgtacacatgtatgtaaaacatgtacatatgcacacatgtgcgtgcatatttatatgtgtatatatgtacatatatgtggatagatatacacatagatatattagaaacagcatttactgagttcaaaccatgtgagacatttatttgttacagtatcctctgtgggaagtacgtaggtcgagcccattagataacaaccctcttgccttctgtgcttctgtaccaagtgagaaacaagaacagcagtaaggcatagggtaagtcaaacatcaccttaatttgttgaagaagctgccgttgaccatggtttgcatctgcatgggaggcacatgcccatctggacatgggcagtgtctatattggcaggatgtcactcaggtgtcagcttgtcccactgcttggtggctggtggcaatggagagcacttgctctctttggtcaggcctgttcccaagagagaattgtaggtgaaaggagtctcttcaaacttccaggctcattaagttatctgtcatgtatcctgatccaggctcccctcaaaccaagaaaaagtgggtactggggagtggtgaggtcagaagtcattccctcgaggagctgcctctctagggaagaaaatatcagtattgaggcagaagtattcaacatccacaccccaaccttaggtgctacttttaatcccgttttacaaacgaaggcattttagcacagaaagataagtggctatcccaaggggggatccagatccaaatccaggcatccgaccaaagagtcttaggcatatgctttactgtctgccctgtctgctccacacattcctattcatcgttttttattatttatttttaatcttactgaaacagctataaaaaaaagcaggtttatgtgatgtaaataagaacaattttaaattttagtttggttaataattagtcacttacataaaataaaatacgtgaccgtaatgtaatgatcttgacaaagcagaaaggctgacaggggagcagggaagaaaggaatacaagctgttctttgaaaatgaggttaaaacaactgccatacttcgaatctgtagacacagaggcaggtgaaaagtgtactcaatatcgggtattgcttattttttttactgtaacttcttgtttattcaaagtggtgtgccgtttgtataatcagaaaaataaatgtggaggtataaaagttgacatgtttatggtttaaaaatgagataaataaaaatgttaaaactcagaaaatattgagattatgctaacatacacataatccaaagacctggactttgcaaacacacacacacacacacacacacacacacacacacacacacacactcacgtttgttttctccatataagtgaaatgtatgctatattgtatcctcattttcacttcaggataaatcatggcatctttctttgtgtgtgcctgtgcacatgtctatcttctccagttctaatttttttttctttttgagacagggtcttgctctgttgtggccttgagttcgtggtgtcagatgatcctccattctcagcctcccaagtatcttggaccaaatttggctatttattttttctttcttttctttttcttttctttttttcttcttttttgtagagacagggtctggttatattgcccaggctgatctcaaactcctgggctgaagtgatcctgccaccttggcctcccaaggttctgggattacaggcatgagccatcgcacccaaccttcagctttatattgtggaacattatcatgtttcttagttttaattaagcgaggtgtggtggcttgcacctgtagtcccagctactcaggaatctgaaggaaaggatcttttgagcctaggagctctagtccatcctggggaacatagcaagatcctgtatctacaaaaacaaaaacaacccactaagttaattatccttaagtatctttgtcatttatttgctcatatctgaaggaaaagtatcccagaaatacttaaaccctcactggcagagcaaaactttgcctcccttcagagtgcattttcccccacaattttgaatatctaaacattttataaaatggagtctccttgtaagtatttatattcctattaaattaagatttcattttatagttttcttggacatttgcattttacattttgtgaatttgctgtcttttttgaccttcatacatttattgaaacatttatccttattttattgattacagaaactctttatgtaagaataatattgactatgttgtgtatgcctttgcatttttacattttgcatatggcaccaaatctttttcttcatggttgctagcattgtcattagacttacatttttattctatgaaccatgctatctctaaaaatctggttatggattacatgttgaatgtttaaattagaagcatgattaatttctaaaaaatagtgatatgtttatattttgagttttcatggtcttggttctttttgtctgtttttaagggattttttttggtaattggacatattttaaaggtctctcatggactttatatcatttataactactctagaaggcataatttacttcaggatttggttgatatgctgttttaattattctaaaaggctccaaaaatgaatatttgtataatgtttgaaataatctttgactactctgatataaagttaggattatcctgcaggactgagtttatatgaaaaattgaatttattgccttcttaaaatggatgataagaaaagaactttattatcaatgttatttaaatttacttttcataatttttaagaatttaatcatatttgtattcttcataagataaaatcccacaagaaatccaagcttctgcttataaaactttaatcacgcattttattagactcttgttttgcctttcaacttgcagtcctttcttgtacttaactgtctgtgaatgtgaaccttcatgaactaacagacttttcaagtagaatatcattttatagactagaagaaaagacattttgttgccctcctcagtaattttacagagtgaatatacattaaatataatttgaagcttagcattttgtttccttcttataaaataaaaatggaaaattccataatcattaagctttttggagatatctttattagacaagattaatgacaaccttatttacaataaataaaatataaataagttcataggtattttctttatcatagccatttatggtagcatttctgacttacagtaatcatcgataaagtattggtggacaccttttgggtacaaggattgcactaggttctgggaagactacagaaacatctgaaacctggcttcagtgggcttcgtataattacaattcgtaaaatcagttggcctaatactgtctgaataaacttttatttaaaaaaagaaaaaacgaaaatgttatatgtaaacagggactctgggaagatatgaagagttggtagtctccactctcatagaaaacaaagcccgaagaggcaggggtgggaggagtcctaaagaagaaaatgtggaaggaggctcttggaatattgttgtcaactttttaatttaattttagccatgactacttgtattatttattttaaaacctaacttttataaaagaagtcaaaagtggtatttttccattcttatgttcaatacgtccagctttctggctcaaggattttaatctgactataattgtgaacatatccttttctgtatctgcccatccccaacttttacccagctccacacaggaagaaagacagtcctccataaatgttctagagatttgccactgctttgggtctagattgatcccatgtctgaatcagtgcagaaatgcataatttaaaaagtgatttgatcttttacaaagtgccaggctttggacaaaccttgtgtactgtccttacacacacaggtggagatgagtgggaactttactgaggatggtctcttcagtaggagccattaagttgaacatcagtgagaaaataaaaatatctttgaactttccagaaatggttctagaattccctttaaagcagttgtgtagcaacacaaaaaacttgtaattgccctctaggaatgtgttaagtagagttctctctatagagctgagcatgtccaccttacacagatgtgttcaataagcctgaagatgatagactcagaatatttatatatagatatagatatacatacacacgtatatttttgtatatgtgcatacatatacataaacatagtatatacatatatatgcaatacatgcacttactctctatttctaaagtttccctttaaacttattattttctttcaaatgcatatgattatctcaaccattaaatgaggttctgattctgcaaatagataatagactaagctattcagaaaggtctagaaaaatcatcttaaaagtgatttaagaagaggccaaataaagatatatgggtgaagttaaatacccctgttaaacattattgttttgtaagatagctggaaaagttcaccttaatagctcattgctcaaaatgctttggaaattttgaaacatatggctggatatacggtgagctaatgaatatagtttctagtcctagatatgcagctgaaccacagtgtgagtagaaaactagcaaccaactgttgagtgcctcttgtgtactaagcattccgccaagtagtctttgggcataagaagatatgacacagatccaagcctcaaggataggtagggaaaaagacaagaagcaggcaattgctaacaaggccgaagagctgttgagaaagaggaagacaagggaccctgaataaagaatgcaacaaagatgagagaatgggggagggagtggtgaggggagagtatgagaatgggggagggagtgttgaggggagagtatctgacaggaggtagtaaatgtgcaaaggtctggaaataagcgggatggggaacgggaagtgaattatgtgactaaagattgtgggtacaaaggaatctgatgctggatgggagaatccatataggtcttgagtattttgctcatgtggttagatttatcttaagggcagtggaaacatatggaaagatttctgattgtggcttgtgagctatttaattttagccagctatgtaaacctctaatcttcaattccttcattattttcttcatatttgtagagctttaggagctacaagtgcagttttgttacctggatatttcccatcatggtgaagtctgggcttttagtataacatcacctggatagtgtacatcgcacctattaagtaatttcttattcgtttgtaaaacaatgataattactttatcataggatttggtgtccgtttgagtgtgaaaagtagaggagagagattccagaataatcaggcacagctttgggtgttctgggaaataaagtaatataagatcccctcctagccttcatgagaagcctaaagccagttggaaagattaagctagctaaacaaaccaagacatcccaaatgtcacaaatattaaaatattctatgtactttttcatatccaattatcattatctataaaatgtacataacagcaactagtccctacgtagttctcatgaattatggcgcgattgatataacaatatctagtgatcaatataacagtatctagtgatcaatataacaatatctagtgatcaatataacaatatctagtgatacattgaaatttctttggcagtaatctctagaaacatagacatccctctgtgggaaaaagatgatgtccatttgtgatgtgttttatgtatttcacttttttctgtgcttctacaccttgctgttcatgctttcttcacagctagatagggagaaacttaaaaacagaagccatgtcttctacattttgatcactcaaacccttagatttttatctatgttatctgagttttaagcataagaaatgcaattgaatgtgcataaaatataaattatctaacttcctatcgaaatgttttgtaagctttccattgagattcatgattttttcattgaccactgcaatggacagaattatgtcctttcgaaattcatatgttgaaatcctaacccccaatgtgactgtatttggagaaaggcctttctttaaatgagtaactaaaattaaatgatgtcataatgaggggatgcctatccaataggaataatgcccttttaagaagaagagttactggagcactctctccacccttgcacagagagaaaaggccatgtgagaacagagaaggtgttgtctggaagccagggagaggacccttactagaagccaactttgctggtaccttgatcttgaacttcctaatctccagagctataagaaagtacatttgtgtgtctaagccacccagtctgttgtattttgttatggcagtctaagaagactaacacaactacagaaaaggtagatgctgtatgcgttacagaacaatcactaaaaatagaacaactgctaaaaagattctttggtcttttttatcaaaagtgagcaacaatgaagacttatattatcaacattgcttacatattggtagcacaaataatcttagatttctaggagtgtaaaaaattcccatttacaatagcagtggatcaaaaataattgctcatttacataataggtcttgtgtagttcttagatccttataaatttgatgtcctttcatcttatttttgttcgctatcatccctttatttaataattactaagtgtaaggtatgatatatattttaggtcttatatttataaatgacctatatcaatttaatagtaaatatatcattaactgtgatgaaattgtattcttttttaaatcaattctcagatatgctctatgaattcaatttactacaaacaagcatgtatatcttcacacaccatcaattcagatttgtttggaaatggaagaaaacatatacttcaaaattgatatggcttttttccttttattttttgcataggctttaattttattttttacggaacaatatgtgatattagctgctattttttgagcatgtattattggccaaattttacctatccatttgcttgaggttagtggttcatctacctcagacttgggtgttcagtctcttcctacttcagcttgctggtagatcaaccatgttgagttttaggtttaggctctttgccataaatgggaagtagttataataaaatatgttaagataatatttatctttttattgcaatgtgtaattcttattttgaatggagttcttttgaatttacaacatcattgcctctgcctacgtagcagtccttaaattttacatatatctgtaattgcccttattaacaggactcctcagtcatatacatttaatgataatagtcataaaagaagtgccttaggtacgtttgtattgattatcctctacaatgtaattaccaaatgaatcatactgaaatgagttaagagagtttttgtatgtagggttttgatcctaaatgtaggatacaggtgtgtaatataaggcagaattaaatcaagaaaactattaaatcccacctattaggtgcttcttcccattgctatgcagattacttatcttagttattttcctcagctgaaactctggttgtcaaaaggtatgcaaaattaagtgcaaaatatgtttaaaagattctgttgaatatttatatgaattagaagaagaga

SEQ ID NO: 8 - DNA, 7182 bp, Homo sapiens
ctgagactgcagtttagagtctaggtatctcccgcacacggagatggggctgtccccaactagaactgagagctaaggaggaatgacagggcaggagaatccagaagaaggggcttctgtttcccccttcttccatccatccatccgtctttctcgaggcccaggtagtcttctaggtaccaagaaaataatggtgagtaaaacagcccctgccctctcagagcttgtgttatggttgataaaaatatgaatttgaaacagaacctgcaaagtaatcctcacttcctacaattgcaacttttgaaagcttaaagtgagccttctaatttttttttttttttttttgagacggagtctcactctgtcgcccagcctggagtgcagtggtgtgatctcggctcactgcaagctccgcctcccgggttcacgccattctcctgcctcagcctcccgggtagctgggactacaggcacctgccaccgtgcccggctaattttttgtgtttttagagagacggggtttcaccatgttagccaggatggtctcgatctcctgacctcgtgatccacctgccttggcctcccaaagtgctgggattacaggcgtgagccttctaatttttcctccaaattccaaacaagtttttttaatgtgggaaaatacacagtataaaaatttaccatcttaaccatttttaagtgtacaggccaatagcattaagtacattcacactgtcatccaaccgtcaccaccactacccgtctctagaacttctttcatcttgcaaaactgaaactctgcacccactaaatactaacttcctatttcccctcccccagcccctggcagccaccattctattttctgtctctgtgaatttgactatttgactaagggtccggcgtggtggctcaaacctgtaatcccagcactttaggaagctgaggaaggtggatcgcttgagttcaggagttcaagatcagcccggccaacctggcgagaccccgtctctacaaaaaatacaaaaattagccaggcatggtggtgccacacttgtagtcccgcctacttgggagggtgaggtgggaggatcacctgagcctgggaggtcgaggctgcagtacgccaagatggtgccactgcactccagcctgcatgacagagtgagaccctgtctcaaaaaaataaaaataaagaatttgaccattctaggccagatgcggtagctcatgcctgtaatcctagcactttgggaggccgacatgggtggatcacctgaggttgggagtttgaaaccagcctggccaacatggtgaaaccccatctctactaaaaatacaaaaattagctgggcatggtagtccatgctaattccagtcacttgggagactgaggcaggacaatcgcttgaacccaggaggcggaggttgcagtgagctgagatcatgccactgtactccagcctgggtgacagagtgagactgtttccaaaaaaaaaaggaatttgaggccgggcgcagtggctcacgcctgtaatcccagcactttgggaggccgaggcaggcggatcatgaggtcaggagatcgagaccatcctggctaacactttgaaaccccatctctactaaaaaatgcaaaacatttgccaggcgtggtggcgggtgcctgcagtcccagctcctcaggaggctgaggcaggagaatggcgtgaacccgggaggcggagcttgcagtgagccaagatcacgccactgcactccaagctgggcgacagagcgagactccgtctcaaaaaaaaaaaaaaaaaaaaacaaaaggaatttgactattctagtacctcatatgagtgggatcacaccacacttatccttttgtaactggcttcattagcataatgtcctcgaggtgcccccctgctgtggcatgcgttggaattccttttcgaggctggatgatgttccgttagaaggataccatgttttgcttatccattccctggttaacagacgctgggttgcttccaccttttggccattgtgaacaatgctgctaatgctggtgtacaaatacctcaaggccctgttttctaatcttttgtgaatatgcccagaaggcggactgctggatcatacggtgattctatctttagggtgattgtatctttgtgttttgaggagccgccataccgttctccatagtgactgcaccattttccattcccaccaaccgtgcacaagggccccgatttctccacctccttcccagcacttgttattttctgctttttgatagaccatcctaacagatgaaaccaaacatgctttatatcaagtaattttaccttctcgtattgtgtaaaattgataagataccaaagtagacaacagagagtaagaagccccatgtgctcctcactaaccactataatgatccacgcagaatgaatcttgtttgacttcactcccactcccaacaccgataccacttattttgaagcaaatgccagacatcatataacttcccctctcaataccgcatcatacatctctaaaagataacaactctttttaaaactaaccatatcaagtccaatagagcttaaaggtaaaaaataaaataagctgggagaggtggcttatgcctgtaatcccagcactttgggaggctaaggagagtggattgcttgagcccaagagttcaaaatcagctaaggcaacatggcgaaacccgtctctagtaaaaaatacaaaaattagccaggcgtggtgatgcacacctgtagtcccagctacttgggaggctgaggtgggagaatcgcttgagcctggctggtagaggctgcaatgagtcataactgcaccactgcactccagcctgggcaacagagcaagaccctatctaaaaaaataaagtaaaataaataaaaactaaccataatggcagtattacctaaaatttcacaattatttaatatcatcaaatacctaatcagggttcctatttatctgcttgtttggtgtatcaaataatttcactcaagacttttctcgctctgtagggtaagtttgtgttgtttcactccgaattccgctatgaaagaaaaatgaaagcactgataaccttgaacagtaatgcttaggggtttccacaatgtcgccaattcttttttcacctttaagtatgtttattaagtaggttttcgtagatgttatttatcaaattgagagagagcccctctattcctaactttgagagttttcatcatgaatgaatgaatagcatcttctgaaatgctatttcggcattaattggtatgctgtgacttttcttttttagcgtattgattggtgaattattgactgtcaaatgttgaaacagtcttatgtatgtggactagatcctatacggtcatggtgtatcattcttcttgcacattgtttgatttgatttttgttgaggactttttaaatgttttgttgagatcgccattaaaatattttgtcagtatatttcaattcacttttcttttgaaaattctgaaaattctactggcatgaatatatccagttttgtatactcagcatcaaatattacgcatatttcggagcacaggtcaggcgccgtggactcccttttgctgaccactgaggctaatctagcggattcagctatatgaaaggcaagagacagcgacaatcacaaggctatttttgaaaaatcagggtgtgacgatcgcaaatgtgcttttaaaaattaggattaaaaaaaaaacagggccgggcgcggcggctcacgcctgtaatcccagcactttgggaggccaaggtgagtggatcatgaggtcaggagatcgagatcatcctggctaacaaggtgaaaccccgtctctactaaaaatacaaaaattagccaggcgtggtggtgggcgcctgtagtcccagctactcgggaggccgaggcaggagaatggcgtgaacccgggaggcgggaggaggcagaacttgcagtgagccgagatcgcaccactgcactccagcctgggcaacagagtgagactctatctcaaaaaaaaaaaaaaaaaaaaagatggaattgtttctcctgttaaacctggcttaaatatagcaaccctaaagctgaaagacaaagaatttgaaggtttgtagttaaagtggcaggacttcctaaagcaaagttcacaactttttcagatcacaggctttttgctctgttgcccaggctgcagcctccaactcctggactccagaaatccttctgcctcagcctcccgagtagctggggagccaccatgtccagctagttttaaaatttttttgtagagaaggcggtctcactgtattgcccaggctggtctcgaacttctgggctcaagcaatccccctgccttggcctcccaaagagctgggattacaggagtgagccaccatgcccggcccaaatcctttttttttgagatggagtctcgctctgccacccaggctgaagcgcagtggcacagcctcagctcactgcaacctccgccttctgggttcaaacaattctcctgcctcagcctcctgagaagttgggattacaggtgcccaccaccatgcccactaatttttgtatttttagtagagatggagtttcagcatgttggccaagctgctggtcttgaactcctgaccttaagtgatccgcctgcctcggcctcccaaagtgctgggattacaggtgtgagccaccacatgcggccccaaatcctttttagtttaatgttaagatttctggccgggcccagtggctcatgcttgtaatcccaacactttgggaggctgaggcgggtcgatcacctgaggtcaggagttccagaccagtctggccaacatggggaaatcatgtctctactaaaaatacaaaaattagctgggcatggtggcgggtgcctgtaatcccagctactcgggaggctggggcaggagaatcatttgctactcaggaggctggggcaggagaatcatttgaacctgcgaggtggaggttgcagtgagctgagatcggtcgtgccactgcactccagcttaggcgacagcgagactccacttcaaggggaaaaacaacaacaacaacaacaacaaaaaaaacaggccaggcaccaacccaaaacataagcagcaagtgtaacagcaatgccggtattccacactgacttccatcctgagcttcctaaacaactctcatatgccatggctggcagtctctcttgaatgtcacaggtgtgatgtggcagcctctccagcagagagcctcatgtccacctacagcagtgagatttccagcagcaaaggctttagcacaatccttccagaagttccaaagctgacaggtgagatgcgcaggaagggccactcttaaaacacttaggaaataaggggtctccctcatgattgggctgtaaccttgggagagtcatcttacagccatcctgtagggtattaattaccagggacacagactccagccacgggtgtcgggtgtcgggaaccatgcccttggctacggtatccctggaaacacagcatgcccttggcctgaatcccagaataccccagagaggatgcgtgaagatgggtccctgaaacaagagcacgtttgcaggtaaaaatccccaaggagctttggggtcttggaccaaggtggatgggtgcaggggtggggtcaagtttctgctagtgtttctcaagctccgtaccctcaggagcagctgttcatgtgtgaatgttgagtagtcctattccagagctaagttttgtgaaacggagtgagaagggggcaggggaagagacagaggtggacagcctctctctcattccaacatttatctctagagtaagcaaaggtgggaaactggagaaatctcgattaaaacgcagatccctttttttttcttttgagacagagtctcaatctgtccgcccaggctggagtgcagtggtgtgatctcagctcactgcaacctccaccttccagattcaagcgattctcctgcctcagcctccctagcagctgggactataagcacgcgccaccacacccagctaatttttgtatttttagtagagacggggtttcaccatgtttgccaggctggtctcgaactcctgacgtcaggtgatccaccagtctcagcctcccaaagtgttgggattacaggcgtgagccactgcgcccagcctaaaatacggatcctaacagacaaggggagatcaaacctcagatagtaaagagcacgcccccatccatccacggcagctgtgggccgtaatggggcgccaggcaagattttctagacaaccctgttaaactgcacccgctgggcccccgcttcgaatctgagacaatcaatctgacctggcgctgacaggtttgctgtggaacaatttgatgcactccccaacagagaacaatggcctcacagaaggttcatgaatggaggccattcgaaagctttcttgtaagcaaagaagggaggttatcagccttcctgggcaatttccactttgactccaagacgctttttgccctctgtatgtcccgcctcgggtggggtcttcagctttgctcttctaagagattaacttgcaagcagcaccagttacagccactgctgctatcttgtgttttagcatgagcctccctgaagcaaaatcatctcaaaatctctgaaatgtaacgtacagaatttcccacaggcaaaacagtgcaaagttgggaatatcttcagtggtacccactgcctttctgtccatgctgctaccagcttcctagagcttcccctggtgggccagggtttccaacagacaccttcccccataagtgctcacttcattcgcattgggttagaactctcccgctccaacttcccgtttcttcacagccccactaacactggccatttagttcaataaactaattggagggggatgctaatgaccggtaatgacttaaggcactcacactttgtaaagaacctcagcaatttaatataaaaacagggtaagtaacgcaggcactttgcaggctggtggaggaacacgttttcagaacagagccctgagctttcttcagtttataccttgtccagagaattaaatacacagcaccaggggaacaaatccaat

SEQ ID NO: 9 - DNA, 4102 bp, Homo sapiens
tccgaattccgctatgaaagaaaaatgaaagcactgataaccttgaacagtaatgcttaggggtttccacaatgtcgccaattcttttttcacctttaagtatgtttattaagtaggttttcgtagatgttatttatcaaattgagagagagcccctctattcctaactttgagagttttcatcatgaatgaatgaatagcatcttctgaaatgctatttcggcattaattggtatgctgtgacttttcttttttagcgtattgattggtgaattattgactgtcaaatgttgaaacagtcttatgtatgtggactagatcctatacggtcatggtgtatcattcttcttgcacattgtttgatttgatttttgttgaggactttttaaatgttttgttgagatcgccattaaaatattttgtcagtatatttcaattcacttttcttttgaaaattctgaaaattctactggcatgaatatatccagttttgtatactcagcatcaaatattacgcatatttcggagcacaggtcaggcgccgtggactcccttttgctgaccactgaggctaatctagcggattcagctatatgaaaggcaagagacagcgacaatcacaaggctatttttgaaaaatcagggtgtgacgatcgcaaatgtgcttttaaaaattaggattaaaaaaaaaacagggccgggcgcggcggctcacgcctgtaatcccagcactttgggaggccaaggtgagtggatcatgaggtcaggagatcgagatcatcctggctaacaaggtgaaaccccgtctctactaaaaatacaaaaattagccaggcgtggtggtgggcgcctgtagtcccagctactcgggaggccgaggcaggagaatggcgtgaacccgggaggcgggaggaggcagaacttgcagtgagccgagatcgcaccactgcactccagcctgggcaacagagtgagactctatctcaaaaaaaaaaaaaaaaaaaaagatggaattgtttctcctgttaaacctggcttaaatatagcaaccctaaagctgaaagacaaagaatttgaaggtttgtagttaaagtggcaggacttcctaaagcaaagttcacaactttttcagatcacaggctttttgctctgttgcccaggctgcagcctccaactcctggactccagaaatccttctgcctcagcctcccgagtagctggggagccaccatgtccagctagttttaaaatttttttgtagagaaggcggtctcactgtattgcccaggctggtctcgaacttctgggctcaagcaatccccctgccttggcctcccaaagagctgggattacaggagtgagccaccatgcccggcccaaatcctttttttttgagatggagtctcgctctgccacccaggctgaagcgcagtggcacagcctcagctcactgcaacctccgccttctgggttcaaacaattctcctgcctcagcctcctgagaagttgggattacaggtgcccaccaccatgcccactaatttttgtatttttagtagagatggagtttcagcatgttggccaagctgctggtcttgaactcctgaccttaagtgatccgcctgcctcggcctcccaaagtgctgggattacaggtgtgagccaccacatgcggccccaaatcctttttagtttaatgttaagatttctggccgggcccagtggctcatgcttgtaatcccaacactttgggaggctgaggcgggtcgatcacctgaggtcaggagttccagaccagtctggccaacatggggaaatcatgtctctactaaaaatacaaaaattagctgggcatggtggcgggtgcctgtaatcccagctactcgggaggctggggcaggagaatcatttgctactcaggaggctggggcaggagaatcatttgaacctgcgaggtggaggttgcagtgagctgagatcggtcgtgccactgcactccagcttaggcgacagcgagactccacttcaaggggaaaaacaacaacaacaacaacaacaaaaaaaacaggccaggcaccaacccaaaacataagcagcaagtgtaacagcaatgccggtattccacactgacttccatcctgagcttcctaaacaactctcatatgccatggctggcagtctctcttgaatgtcacaggtgtgatgtggcagcctctccagcagagagcctcatgtccacctacagcagtgagatttccagcagcaaaggctttagcacaatccttccagaagttccaaagctgacaggtgagatgcgcaggaagggccactcttaaaacacttaggaaataaggggtctccctcatgattgggctgtaaccttgggagagtcatcttacagccatcctgtagggtattaattaccagggacacagactccagccacgggtgtcgggtgtcgggaaccatgcccttggctacggtatccctggaaacacagcatgcccttggcctgaatcccagaataccccagagaggatgcgtgaagatgggtccctgaaacaagagcacgtttgcaggtaaaaatccccaaggagctttggggtcttggaccaaggtggatgggtgcaggggtggggtcaagtttctgctagtgtttctcaagctccgtaccctcaggagcagctgttcatgtgtgaatgttgagtagtcctattccagagctaagttttgtgaaacggagtgagaagggggcaggggaagagacagaggtggacagcctctctctcattccaacatttatctctagagtaagcaaaggtgggaaactggagaaatctcgattaaaacgcagatccctttttttttcttttgagacagagtctcaatctgtccgcccaggctggagtgcagtggtgtgatctcagctcactgcaacctccaccttccagattcaagcgattctcctgcctcagcctccctagcagctgggactataagcacgcgccaccacacccagctaatttttgtatttttagtagagacggggtttcaccatgtttgccaggctggtctcgaactcctgacgtcaggtgatccaccagtctcagcctcccaaagtgttgggattacaggcgtgagccactgcgcccagcctaaaatacggatcctaacagacaaggggagatcaaacctcagatagtaaagagcacgcccccatccatccacggcagctgtgggccgtaatggggcgccaggcaagattttctagacaaccctgttaaactgcacccgctgggcccccgcttcgaatctgagacaatcaatctgacctggcgctgacaggtttgctgtggaacaatttgatgcactccccaacagagaacaatggcctcacagaaggttcatgaatggaggccattcgaaagctttcttgtaagcaaagaagggaggttatcagccttcctgggcaatttccactttgactccaagacgctttttgccctctgtatgtcccgcctcgggtggggtcttcagctttgctcttctaagagattaacttgcaagcagcaccagttacagccactgctgctatcttgtgttttagcatgagcctccctgaagcaaaatcatctcaaaatctctgaaatgtaacgtacagaatttcccacaggcaaaacagtgcaaagttgggaatatcttcagtggtacccactgcctttctgtccatgctgctaccagcttcctagagcttcccctggtgggccagggtttccaacagacaccttcccccataagtgctcacttcattcgcattgggttagaactctcccgctccaacttcccgtttcttcacagccccactaacactggccatttagttcaataaactaattggagggggatgctaatgaccggtaatgacttaaggcactcacactttgtaaagaacctcagcaatttaatataaaaacagggtaagtaacgcaggcactttgcaggctggtggaggaacacgttttcagaacagagccctgagctttcttcagtttataccttgtccagagaattaaatacacagcaccaggggaacaaatccaat

SEQ ID NO: 10 - DNA, 8259 bp, Homo sapiens
agagagtgtcattagcaacagtgagagtagatggatctggaattggactgaagcggagttgaatggttgatggagggtggcgggaacatgaagacggcccacaggggttgctgtgagtcacatatgcttttaagatgagagacccttgagcatgcatgtcagctagttattgctgtgtaacaaacaactcccatgctctgggatgtttttattgcttatgcatctgtggatgggctggggatctgttgatctaaactgtccttgctcaagtctgtgggcaagtcggggacctgttcttgggcacttcggctggggcagctctgctgcatgcattactcatcctcttcctgggagcagcgagccagcctgggcatgctcttcttggggagacagctgaggcacaaacatgcatgaaagtctggataagtacatttcaaccttctgcttccatcacgcctgcaaacatcccatcggccaaggttccactagacagagaactgggaagtcacttaacaaagggcagtgtgaagaagatgggccattagtgcattgtaggaactaagggccttctgaaggttcactaaaatcaacttgcaaaaggcaggtgaataagagaagaggcatacaaaagaggccatgttcccataacatgcgtacatgggagccttcggaatgaaaacccaaaaatgcaggaggaattttccatttttctgcttaggttcaacaaagtgtggacagttatgtagaaatatagttggacaggccaggcacggtggctcatgcctagaatcccagcactttgggaggctgaggcaggagaatggcttgaacccaggaggctgaggttgcagtgagccaaggtcgcgccactgcactccagcctaggtgacagagtgagactgtgtcaaaaaaaaaaaaaaaagaagaagaaatataatgctaataaatagactgagtggggaaaccccacaggcctgcctgtctcctcgattcttctaggtttctctgagcagcacttcttccttctgggagtgactctccctggaacaggggtcttatgacctacagtcggacatggcaagtcagataatttctttatgttagggcagtatttttaggttttagggaacctttaggctggccttagggaaaaggggttctggtttcaaagatctgccttggggaagagggattccagtttggatggctggcctcagggaagaagggactgagacatgggagggcaggagggcagagagaaacctttgcttctgaggccttcactgtggggtattgctttctgagccccaacagcattctgagggaagtgggtctgcaaggaatgagaggttgatgagaaacaggagggatctgataaatattccacagcagtgggcagggagtggctgtcaagcacaggaggggaggagcagggataagcctccttcagcaagaggagaatcccctgcgttttcaataggaaaagtgaactgaggattgacgaggttcataaacttggaaagaagagctttcttctcataaagggttgcagcctgcagggtggctattgtggcagggaagcagcgcctctggccagaagccagaaacagacccttccaggggcagaagaacaagacagaagaacaatgcatgctgaaggaggtggctcaatacacatattccataagctatgggagaagcattgaatatcgatgagaggagaaacacgcaagtgtgcaatcgagctccgtgcctctccctgggacctgtgttcaaaaagcaacagcgttagcatgatctgagggtggagttttcaggccctgacctcaaaaggtgaagcagaggacatgaaaaccctcactgcgcgtcctctgtggacctgccggacgcactccaaagccatggccagtgtctctcatgaggacggaatgctggtcggttgtttcatccaaattgcagaacggcggggcagcatcaggcggttggtttatatcagtggaggagtctttagaacgggctggtttctgtttagacttaggaaagaaagcctcacggttagcaaggaatgggtataacgaggcgcattgcccttccatcctgtcatagccaggactcagttttcaagggttctctggggtccccttgggcaggagggggtcggttcagtccgttggatggctcaggatttcacttttccttctcggaggcccgtgaatgtgggcagcgtggggggcgatgggggaaagccgagggacttcccttctggtggtttctgttccctctatgaacttgaagatgagtcatccaggagaggggtttgcgtgaggtcggtgacttccatgtgaaaaatttaacattttccccatggggcctggggaagagtcaaccgggaagcacaggagcactgctggggcaggctgagaagccggtcgggcccgggtggcgtgggtgtccacctctttgtgtcccccaacgaaggcaccttcgcatccatgcagagcggaaccaggggtgtggcggggccaggcgtcatttccagctttcctcttttgcataccacagacctgtccatccactcatttaggagctctctgaatcaagcactcctctccctcctcctgcccggggttgggggctgggctccatctctgcctcctgaatgctcccgtggcttcctggtgagctccccaccactgggagagcctcaggtccagggtggagaggccccacaccaggccgcacagccagctgtgaatcatggtcctgaccttgcactctttttgaacggctctatgctagtttccccttttttatttttatttttatttatgtatttattttgagacagtgtcttgctctgttgcccaggctggagtacagtggcatgatctctgctcactgcaacctcctcctcctggtttcaagtgattctcctgcctcagcctcccgagtagctgggattacaggcacccgccaccactcccagctaatttttctatttttagtagagatggggtttccccatgttggccaggctggtcttgaactcctgacctcaggtgatccacccccctcagcctcccaaagtgctaggattacaggcgtgagccaccatgcccagccagttctcctctttttttttttttttttctttttgagatggggtcttgctctgtcaccaggctggagtgcagtgatgcaatcttggctcaccgcaacctccacctcctgggttcaagcaattctcctgcctcagcctccggagtaactgggactacaggtgcacgccaccacgcccagctaatttttatatttttagtagagatggggtttcaccatgttggccaggacggtgtgatctcttggccacgtgatccacccgcctcggcctcccagagtgctgggattacaggcgtgcgccactgcgccaagcctatctcctctttttttaaaataaacttttgatttgagaatagtttatgtttacagagaaaccacaaacactgtacagagaatgcctgtgtgcctcacactggttccctctgttgttaagatctgacgtccgtgacgcgctgaacacaatgaatggacgcgtgtcaattcaccattattaactgaagtccgttctttattcggatttcctcagcgtttcccggatttcctttttctgttgcaggatcgcatgtggcatttagcactcatggctcctcaggctcctcttggctgtgagcttctcagacttctcttgtttttcatgacctcgacagttttgaggaggactggtcaggtacattgcagaatgttccttaatttggacgtgcctgatgcttttcttgtgatgagactggagttatgagtttttggaggaagacgcccgataaagggctgatgggccttggtcacctggctgaggtcatgttagcagatttctccactgtgaggttctctccctcctcccccgtttccgtgtaatagtctttcacaggaagtcagtgcacgcagcccgcgggttaaggaggggggaacacgttctagccccttgagagtggagtgcctgcctggattattcagaatttttcttccagatttttctattctgctgggcaccttttacacacagattgtctcctataattttcacaaatgggaggttgatattatccctcattttacagatatggaaaagctgacttccaaaagacacccggattctgagtggcaggcctgggccttgaacctggctgttctcagagccagctctcttcagtactgagctcattgtctacactatgttccagtgacgcgatttcattcaaattcacttcctccctgggtcacttgtgaccctctcttaagcagggtagggcttattggtggagagggggtgttctggggttctctaggtgaacctaccctttaaaagggcttctctgaggatttcaggaaccaagtccgattccataatgtccaagttggactgggctcaaactagatttttttcttttttttttttgagacagggtctcactctgtcgtccaggctggagttcagtggtgtgatcttagctcactgcaacctccacctcctgggttcaagcaatgctcctgcctcaacctcctgagtagctgagaatataggcatgcaccagcacacccagctaatttttgtatttttagtagagacaggcactatgttgcccaggccggtcttgaactcctggcctcaagtgatctgcctgccttggcctcccaaagtgctgggattacaggagtgagccactgcacctggcctcaaactagatttcaatatggcgtgtgtttgggttcccttgtgcaaggaaggctgtgtgtctcatatatgtaaagaaaaggaaagctccttttggttactcatcatggtttttaaagaagaaaggttaatacttatacattcttagaagtattgggtccacctttgatttccattgaatggggtcatctgtgtgatgagaggtattattctgccatcctgggaaaacccgtgggaagcagggcgtgatttcttggatcatcgaaagctcaggcctgtagtcagaacaagttgactgcatgttggtttttctggactcaacataatacgcagaacagatctatataatgggtggtttgctctgtggactttgagtttttcctctttccacctgttcaaagtgctgaggatatatcagtgcaaaggaacatcctgcagaagattgtgacggacacgctatttcacagtttaaagaaatggctccaaaggaattgcaattcattttactatgcccctggttaaatctaactgacaggtgccgccaagcatttaactggaccataaaccaaactgagatcaaaggattcccccaccttcccataccacccagttgagagtaattcagcagctctgggtacctgacagctggccttagcccctccccgcacatagtaaaggacgagggagagcaatgtggtgtaaatgagtcaaaaaagcaccagcgactggctgtgagtcacgcagcgaggggatcgtaccctttgtttcctgcttataacctgaacactgttagactcatcagggcttccttttcaaaaagatacatggttccccttttcacatttgtggagagctcaggagatgggctgaggtcaatggcgagcttgctcctcaggagagttcacccctgattttggttgcctgttccttcttcttttggattgatgaagagcaaacccacaggatttcatactggtgaggcagcagcctggagtggccctcaaaggaggaaactgggttccaaccccggcagtactatccctcagggtgtggctggggagacagaagccacttgatatatcggagggtttcatattggatttgctgaactgaaggggctaggggagcagaggccaagggcgcccagccctgcctactggagatctcagccgcagcggggaatcctggaggctgctgcagcgtcatgctcacgtagtattctgtctgcagaggtgggctgggctggggaggcacctcaggtctcatgcctgcccgaccccagagtgatgtccttgccacctctctcccatcccaaatctcaggcagtgccacccattggaagtttctgtgcaaaccagatgcctgtggagattctgggcccagggcccggcttctccatgattcaggtgttcctggggggagggaggtgatgccaagttaaggagagagtgcatagaaatgtccacgaggcccctgcagctgcgacagtgggggctgaaaggaacatgcttgagttggaatgaataagtggggatttctgagcactgcgtcatcggtgcataagaatggggactgtggccagacacagtggctcacacctggaatcccagcactttgggaggctgaggcaggagaactgcttgaatgcaggagtttgagaccagcctcggcaacgttgggagatcccatctctacaaaaaaaaattttttttaattagctgggcatgatgatgctcgcctgtgagcccagctacttgggaggctgaggagggaggatctcttgagcccaggaggtccacactacagtgagctatgatcgtgctcctgcactccagtgtgagtgacaaagagagactccatctcttaaataaacaaaaaggatgggaactgggtacccagcacctcccctggggttcaggaggagagactcgggcagattgctcatattcccaagagtttcagacctcatcagcaggggcctggatggaggtggcagctcaggggagggtgcagcagagggagagaggaaggaagctctttccaccaggtgtggttggtcacgaaggagtgaagtctgagcttcggggacagtggttctcacctggggtgttcttgccccaccgatggcggtttggtggtgtctggacacagttttggttgtcacaacctatgcgggagtgggggtggttgctactggcatctatcgggtagagaccagggatctgcctagtgtcctgcagtgcacagggcagtccccacaaccaagagtcatgcggccccctgtgccgactgtgccaaggctgggacggaccctgctccaggacactgaagtgggggagggggagatgtattcacacaaggacttatgagctagccggcatcaggtggcatggacagttgacccaagaggatgctctcccactccattttggttttccatgggagaatcctggaaacagcactgttgctgtgacattctccttattcaccattaactgagagcaccatgggcgtgcctgggaatgagcagaaagttagatcctttttggaggtgcaaggtgagaaaggggagaaatctgtgttctctgagacatctccttacctgctttgctttatagctgagggccttgcctgcgacactctgtgggatgtgtgtgggcgtaggtagttagacacacacacacacacacacacacacacacacacacacggcggcggggggaggggtggtggtgggtaagggtggagagagagactcctgcttctgggtgggaacagggtgccagcgtgaattggcactgtcctattgctatgatgatgactttttcctccctgcagctctggagcacttggaagcggttctgaagctcatttgcagctttgcatctgtttgcacgggcgtctcctgctgggagttgaggcttcctgccctcattggctgtctgaggctgcgctccctacctgcccgcagcgtccctgccccccacatccacccccagtagtgtaatgggacagctcctccctcgagtgctttgccgaaggggacctgcaagaacccaaaacagcagcgctgcagccagggcggtgccttctcctttcctctgtttcctgggctccaggagaattctgtcttggggtccgagaaaaactcacacagcagaccggctggcccagggctgactcagtgtttctttctctctctaggaaggcctggctggaaccagcacattttgtggaagtgggaaccaatacacgtgtacacttctctttacagggcacgctatcatcactaactacttgttgaactatttccctggtcttgaccttgaaaggaggaacgcgttcgggttcaccgccctgatgaaagccgccatgcagggtcgaacggactgcatccgagccctgatgctagcaggtatgtccacctgtcctgtgcagcttccaggggccctgggacaccagagttgctc

SEQ ID NO: 11 - DNA, 22768 bp, Homo sapiens
ctggagataactgttgttaatgatttgatgcctagatgggtttactctgccttttcaatttaaataaaatcattattataatgtattttttctttacttcttgttttctttcgttctttctttcttttctttttttttttttttttgagtctgagtcttgctctatcgcccaggctggggtgcagtggcacaatctcagctctctacaacctctgcttcccaggttcaagcgattctcttgcctcagcctcccgagtagctgagattataggcgccagtcaccgtgcccagctacttcttgtattttcagcagaggcggggtttcaccatgtaggccagactggttttgaactcctgacctcaagtgatccgcccaccttggcctcccaaagtgctggaattacaggcgtgagccgccgggcctggccttttttttcttttttactggcttttgttatcttcccctacttactgatttgcttgagctctctgtggccgccactgtgtgcacccaccctctggcctgggctctgatccctggacacccaacctaggctgctgcctgaggctttgggactgaattgttgaggttgcatacggaggcagaggggagagggactttacaccatttaaacaaacacagattaaaaagcttccttgtgtgtgtcttaattgcctcaatgtgccgaagagattttccctaatttctttctgaacctccaggggctgcccctgtccccatgggcatagtttccttagacactggctcccaatcttgcgcctccggcgtcagcatcacctgggctggctcatgtgagcattaacacagatctggtggaaacacagactgccaggccctgcccctggagtctttctttgaataggcctggggtggggcccaagaatgagcagatcaacaggtttcctggtgaggctgatgccactggcccagggaccccacattgaggatggagagctttgaagattttatgcctgatgacggcaaaggacccctctcagtgggcactgaagaccagcagagtcacagaccccacgagagatgttgtcagacagacacagaggcatcacggaattaaagtgaaaatgaggaaggcaggtgagcatgtgttcatgactttcctgtgctgttttgccaaagaggctgtttaggcccaatcaggtgatgtcccattttaatcaatttcataaccagttttatttctttgatgatttgttaatttcaaaagctgtccatgcatatttgcttacagccaaaaatgactacaaaagtattatcagggaggaagaaaaagatcccttctctgtcttccaaatattccagctcccttatcagcactcaggagtcacctcttcagacctcattcagtcctttccaaacacacacgtatgtatgtgcgctttgtattcacatgactgggctagtgctgttgagactgtgtttttagtggttttgttcacatggttattaatctagaagctcctgctgtgtcggtgtccctgagccctgccaggcgctcgtagccctgccttcctgcacggggatgtgtggctcatgcccggttccccaccaagacttcaaatttgagaggctgcgttatgactggccttcactcactgtggtggacccggctcttaggccagtccttgaacatgaagtacttgcttcttaaatatttgttggaaaagaggatattgtgtaaaatgcatgaaccgtggtatacttaactgtcccagttactggacaggtgggcttttgagttaatcaacggcagcaaggctgtagtgaagtctttggatctggggtgcatctctgaggacagcgtgttaggatcctggcagcttgaagcatgttgagtgacaggtggtctcagagggctgaacagaggagttgatgagggcctgtcaattacggggggaagggtagagttaagggaaccaacattgaaaggattaaggggagggactctgcagagagtgacccaggccaagaagctggaacccgagaggcagcctcggcctagaacccgagtgacacaggccaagaagctggaacccgagaggcagcctcggcctagaaccgcagccaggggccggagtgggaggcagggccagatgtcccgctccttccaccctggtcccctgctgagccaacccagaaacctcattggggcggaaactgggcaggtgctgttggtgcaggtcagcttcctaggccgaaagcagggcaaggaagaggagaagcaatgtgcagacacactcttagaacagaattgcttcagcaagggctgtgcctgttttaagtgtatgcagctgccaagtggtctttagaaagctgtggcgatttctcctttcccctgagtgtccaagagtgttcttgcaagccctggctgagatcagtcttttcagtatttccctactcaaatgaaccaaaactctggttttcagttgtatttccccagctctcttttgagcctagtacctgttaggatgcttttggcttcaaccacaaggacactgccttctcttgcaacacaagacatctgcgggcgatgttgcagggttgcttcactgagtagctgggtgatgctgggacctagagccacttctcagaaatacattcgccttttccttcatggtcccaaggtggccccagctgctagaagtgccacggcttcacgttgcaacactcagggacatcaaggaagaggagcaaatccctgtcggcgtttccctttataagacaggaaaacatttccagaaggctccagcagagtatcgttgccatctcaccaaccagggttgcgtcacaagcccgtgccaaaccagtgatggaggatggcttgtgtagacagcagtcgcactaagcagaatcagcattgtgaagcgcaatcttaaagcaaccatatgtttatattatttgctatggcaactgggttggttgtctgagagttggaagctctgggtttctggaggacacagcatttatgagtacgaattcggatgcaaatgccttcatctgccttttgagtgttctctaaaaagtctaatttcctcggctatttaatgcacaataaaaatacagccaaatctgtactaggtctgtaaatggagagaacgtttgaaaataaatccccatgtaatccctaagtctcatttagccagtcatttcaactttcaccaccgctccactaacaaaaataaaataagataaccaaagaaaggaacaagaagtcccatggatagagttgtgtgtttatttctgtttccttgttgtgctttaacagaatagcatggacgtggtaaagtgaggaaacgccaggggtctctttgagctggtgatgggatacagcacgtgaagcttgttttgggtataaggaacctctgatgtgtgcttgcaacttgttatttcttgcatttaattgtaaaattctgaggctacgtgctgagagccagcctggcaggatgctgcccggggacggggacagaacgggagggattctcaggggcagctgtgggtttgggctgcgggggagccctggttcctgagctgaatcggggagagtcccagttcagaggagaatttatgacttggtcagaacccaggaacaatgcctcttcatgttatttatcttattttattagcagtgcacacgatcacgatcttagtgtgatctcattgtgatgttcatgttgttttgaagtgcttccttttttctcagtttataccgtttcaaataagagagtagaacttggtgagtctcggtttcccagcgttgccttatcttttcctgtgagcttttctgagctcttctgattggccatggcagcgccacacccctgcccgctggccagccaggagggctcctcagccagcttggggcttgcctggctcctccttcagacccctgcctgccctgcaaagagcagggatgctgccctcccctactaaccctgcccctccatctgcatggtaaatgccttatgctaagaattcctggagtctgttcatgccgcgtggctggtatgatgtcatatttccaaagccgacagctccctctactggcctggtctggagaactgcagtttgagtgccttgagtcagtcaatcttagacaacccaattctgtaacattttccaatttttagagcagtttgtgtttattgcctgttttttttagatggagttttgctcttgttgcccaggctggagtgcaatgatgtgatcttggctcactgcaatctccgcctcccgggttcaagtgattctcctgcctcagcctcctgagtagctgggattacaggtgcctgccactacgcccagccaattttttgtatttttagtagagacggggtttcaccatgttggccaggctggtatcgaactcctgatctcaggtcatccacccacttcggcctcccaaagtgctgggattacaggcgtgaaccattgcgctcggccagcccagctaatttttattttttgagatgggatcttgccatgttgcccaggcttgtatctaactcctaagctcaagtgatcctctagcctcagcctccctggcctcttcgggccttggcctctctgctgggattacaggcacgagccaccttgcccaccctgatactttcaataaataaacttttcccaaaggagtggtaggaatgtttcagccttttcatctaatgcatatttattgagcaccccagagcatgcagtcagttggaagttttaagcatgtgagctgggtaacgagggctgtggcggctgtgggaacccatatatgcatgggaacgtggacgatgagacaccgtgggtcaaggggcaccagggaagacctggagttggaagggatggctcatcaggtcaccaagtaaaaagaggaggcagaatattccaggtagagggactccttgtgcagaggccactagattagaggaagtgtggctcatgagtgaattacacggaatgctggctgtttgaccataaagtggattgggagggcattggcggtgagagctgagggtgaagaggtaaaaaccagctcattgaagagttgagacctcatctaaagagcagagcccatggagagtttcggatgagtagtggggatggtcagaggcccctgttggtgtcaccgtgctgctggtgtggagaatgaatgggggcagaagtgggacaaaggaggctagtcaggacaggagctgtggccccatggggacgtggtagcccaggtcagggatggagaaacaaagacagttttaggaaatttaaacttttttttgtagagatgaggtcttgccatgctgcctatgctggtctcaaattcccgtgctcaagtgatgtcagaggtgcagttggcagaatgtggtgattgcttgggtgagggaggatgtggagggcttgagactgagtccagccgtctggcttgggtgatggggtgactggtggtgttcatcactgaataagggatgtgggagaggagtagcttcggaggaaagatgttttgggtttgatgcattgagtttgtaggatacccatgatgaaatactcagtagacagatactcaggtaaaaaactgaagaaaagagatagaactggaaagagttgatgtggaagctttagagctgaaacttggatccacaggagtgtataggatcaccaaaggagagtgtatgagataaggagggggcttagcaggcagctgaggaacagcagcatttcaggaaggagagaacaggagctcagaatgttgagagggcggaaaatcagaagggtgagcatctgcatgtccatggaaagagcgtgtttcagaaaggatgaaagagaggagtgagtgggaaatgctggggagatgttgaatgtgatgagaactgacaaatcaccactgagtctcattgtaagaaggtcactggggactgctgggggtggtttcagcaaagtcagagagtgtcattagcaacagtgagagtagatggatctggaattggactgaagcggagttgaatggttgatggagggtggcgggaacatgaagacggcccacaggggttgctgtgagtcacatatgcttttaagatgagagacccttgagcatgcatgtcagctagttattgctgtgtaacaaacaactcccatgctctgggatgtttttattgcttatgcatctgtggatgggctggggatctgttgatctaaactgtccttgctcaagtctgtgggcaagtcggggacctgttcttgggcacttcggctggggcagctctgctgcatgcattactcatcctcttcctgggagcagcgagccagcctgggcatgctcttcttggggagacagctgaggcacaaacatgcatgaaagtctggataagtacatttcaaccttctgcttccatcacgcctgcaaacatcccatcggccaaggttccactagacagagaactgggaagtcacttaacaaagggcagtgtgaagaagatgggccattagtgcattgtaggaactaagggccttctgaaggttcactaaaatcaacttgcaaaaggcaggtgaataagagaagaggcatacaaaagaggccatgttcccataacatgcgtacatgggagccttcggaatgaaaacccaaaaatgcaggaggaattttccatttttctgcttaggttcaacaaagtgtggacagttatgtagaaatatagttggacaggccaggcacggtggctcatgcctagaatcccagcactttgggaggctgaggcaggagaatggcttgaacccaggaggctgaggttgcagtgagccaaggtcgcgccactgcactccagcctaggtgacagagtgagactgtgtcaaaaaaaaaaaaaaaagaagaagaaatataatgctaataaatagactgagtggggaaaccccacaggcctgcctgtctcctcgattcttctaggtttctctgagcagcacttcttccttctgggagtgactctccctggaacaggggtcttatgacctacagtcggacatggcaagtcagataatttctttatgttagggcagtatttttaggttttagggaacctttaggctggccttagggaaaaggggttctggtttcaaagatctgccttggggaagagggattccagtttggatggctggcctcagggaagaagggactgagacatgggagggcaggagggcagagagaaacctttgcttctgaggccttcactgtggggtattgctttctgagccccaacagcattctgagggaagtgggtctgcaaggaatgagaggttgatgagaaacaggagggatctgataaatattccacagcagtgggcagggagtggctgtcaagcacaggaggggaggagcagggataagcctccttcagcaagaggagaatcccctgcgttttcaataggaaaagtgaactgaggattgacgaggttcataaacttggaaagaagagctttcttctcataaagggttgcagcctgcagggtggctattgtggcagggaagcagcgcctctggccagaagccagaaacagacccttccaggggcagaagaacaagacagaagaacaatgcatgctgaaggaggtggctcaatacacatattccataagctatgggagaagcattgaatatcgatgagaggagaaacacgcaagtgtgcaatcgagctccgtgcctctccctgggacctgtgttcaaaaagcaacagcgttagcatgatctgagggtggagttttcaggccctgacctcaaaaggtgaagcagaggacatgaaaaccctcactgcgcgtcctctgtggacctgccggacgcactccaaagccatggccagtgtctctcatgaggacggaatgctggtcggttgtttcatccaaattgcagaacggcggggcagcatcaggcggttggtttatatcagtggaggagtctttagaacgggctggtttctgtttagacttaggaaagaaagcctcacggttagcaaggaatgggtataacgaggcgcattgcccttccatcctgtcatagccaggactcagttttcaagggttctctggggtccccttgggcaggagggggtcggttcagtccgttggatggctcaggatttcacttttccttctcggaggcccgtgaatgtgggcagcgtggggggcgatgggggaaagccgagggacttcccttctggtggtttctgttccctctatgaacttgaagatgagtcatccaggagaggggtttgcgtgaggtcggtgacttccatgtgaaaaatttaacattttccccatggggcctggggaagagtcaaccgggaagcacaggagcactgctggggcaggctgagaagccggtcgggcccgggtggcgtgggtgtccacctctttgtgtcccccaacgaaggcaccttcgcatccatgcagagcggaaccaggggtgtggcggggccaggcgtcatttccagctttcctcttttgcataccacagacctgtccatccactcatttaggagctctctgaatcaagcactcctctccctcctcctgcccggggttgggggctgggctccatctctgcctcctgaatgctcccgtggcttcctggtgagctccccaccactgggagagcctcaggtccagggtggagaggccccacaccaggccgcacagccagctgtgaatcatggtcctgaccttgcactctttttgaacggctctatgctagtttccccttttttatttttatttttatttatgtatttattttgagacagtgtcttgctctgttgcccaggctggagtacagtggcatgatctctgctcactgcaacctcctcctcctggtttcaagtgattctcctgcctcagcctcccgagtagctgggattacaggcacccgccaccactcccagctaatttttctatttttagtagagatggggtttccccatgttggccaggctggtcttgaactcctgacctcaggtgatccacccccctcagcctcccaaagtgctaggattacaggcgtgagccaccatgcccagccagttctcctctttttttttttttttttctttttgagatggggtcttgctctgtcaccaggctggagtgcagtgatgcaatcttggctcaccgcaacctccacctcctgggttcaagcaattctcctgcctcagcctccggagtaactgggactacaggtgcacgccaccacgcccagctaatttttatatttttagtagagatggggtttcaccatgttggccaggacggtgtgatctcttggccacgtgatccacccgcctcggcctcccagagtgctgggattacaggcgtgcgccactgcgccaagcctatctcctctttttttaaaataaacttttgatttgagaatagtttatgtttacagagaaaccacaaacactgtacagagaatgcctgtgtgcctcacactggttccctctgttgttaagatctgacgtccgtgacgcgctgaacacaatgaatggacgcgtgtcaattcaccattattaactgaagtccgttctttattcggatttcctcagcgtttcccggatttcctttttctgttgcaggatcgcatgtggcatttagcactcatggctcctcaggctcctcttggctgtgagcttctcagacttctcttgtttttcatgacctcgacagttttgaggaggactggtcaggtacattgcagaatgttccttaatttggacgtgcctgatgcttttcttgtgatgagactggagttatgagtttttggaggaagacgcccgataaagggctgatgggccttggtcacctggctgaggtcatgttagcagatttctccactgtgaggttctctccctcctcccccgtttccgtgtaatagtctttcacaggaagtcagtgcacgcagcccgcgggttaaggaggggggaacacgttctagccccttgagagtggagtgcctgcctggattattcagaatttttcttccagatttttctattctgctgggcaccttttacacacagattgtctcctataattttcacaaatgggaggttgatattatccctcattttacagatatggaaaagctgacttccaaaagacacccggattctgagtggcaggcctgggccttgaacctggctgttctcagagccagctctcttcagtactgagctcattgtctacactatgttccagtgacgcgatttcattcaaattcacttcctccctgggtcacttgtgaccctctcttaagcagggtagggcttattggtggagagggggtgttctggggttctctaggtgaacctaccctttaaaagggcttctctgaggatttcaggaaccaagtccgattccataatgtccaagttggactgggctcaaactagatttttttcttttttttttttgagacagggtctcactctgtcgtccaggctggagttcagtggtgtgatcttagctcactgcaacctccacctcctgggttcaagcaatgctcctgcctcaacctcctgagtagctgagaatataggcatgcaccagcacacccagctaatttttgtatttttagtagagacaggcactatgttgcccaggccggtcttgaactcctggcctcaagtgatctgcctgccttggcctcccaaagtgctgggattacaggagtgagccactgcacctggcctcaaactagatttcaatatggcgtgtgtttgggttcccttgtgcaaggaaggctgtgtgtctcatatatgtaaagaaaaggaaagctccttttggttactcatcatggtttttaaagaagaaaggttaatacttatacattcttagaagtattgggtccacctttgatttccattgaatggggtcatctgtgtgatgagaggtattattctgccatcctgggaaaacccgtgggaagcagggcgtgatttcttggatcatcgaaagctcaggcctgtagtcagaacaagttgactgcatgttggtttttctggactcaacataatacgcagaacagatctatataatgggtggtttgctctgtggactttgagtttttcctctttccacctgttcaaagtgctgaggatatatcagtgcaaaggaacatcctgcagaagattgtgacggacacgctatttcacagtttaaagaaatggctccaaaggaattgcaattcattttactatgcccctggttaaatctaactgacaggtgccgccaagcatttaactggaccataaaccaaactgagatcaaaggattcccccaccttcccataccacccagttgagagtaattcagcagctctgggtacctgacagctggccttagcccctccccgcacatagtaaaggacgagggagagcaatgtggtgtaaatgagtcaaaaaagcaccagcgactggctgtgagtcacgcagcgaggggatcgtaccctttgtttcctgcttataacctgaacactgttagactcatcagggcttccttttcaaaaagatacatggttccccttttcacatttgtggagagctcaggagatgggctgaggtcaatggcgagcttgctcctcaggagagttcacccctgattttggttgcctgttccttcttcttttggattgatgaagagcaaacccacaggatttcatactggtgaggcagcagcctggagtggccctcaaaggaggaaactgggttccaaccccggcagtactatccctcagggtgtggctggggagacagaagccacttgatatatcggagggtttcatattggatttgctgaactgaaggggctaggggagcagaggccaagggcgcccagccctgcctactggagatctcagccgcagcggggaatcctggaggctgctgcagcgtcatgctcacgtagtattctgtctgcagaggtgggctgggctggggaggcacctcaggtctcatgcctgcccgaccccagagtgatgtccttgccacctctctcccatcccaaatctcaggcagtgccacccattggaagtttctgtgcaaaccagatgcctgtggagattctgggcccagggcccggcttctccatgattcaggtgttcctggggggagggaggtgatgccaagttaaggagagagtgcatagaaatgtccacgaggcccctgcagctgcgacagtgggggctgaaaggaacatgcttgagttggaatgaataagtggggatttctgagcactgcgtcatcggtgcataagaatggggactgtggccagacacagtggctcacacctggaatcccagcactttgggaggctgaggcaggagaactgcttgaatgcaggagtttgagaccagcctcggcaacgttgggagatcccatctctacaaaaaaaaattttttttaattagctgggcatgatgatgctcgcctgtgagcccagctacttgggaggctgaggagggaggatctcttgagcccaggaggtccacactacagtgagctatgatcgtgctcctgcactccagtgtgagtgacaaagagagactccatctcttaaataaacaaaaaggatgggaactgggtacccagcacctcccctggggttcaggaggagagactcgggcagattgctcatattcccaagagtttcagacctcatcagcaggggcctggatggaggtggcagctcaggggagggtgcagcagagggagagaggaaggaagctctttccaccaggtgtggttggtcacgaaggagtgaagtctgagcttcggggacagtggttctcacctggggtgttcttgccccaccgatggcggtttggtggtgtctggacacagttttggttgtcacaacctatgcgggagtgggggtggttgctactggcatctatcgggtagagaccagggatctgcctagtgtcctgcagtgcacagggcagtccccacaaccaagagtcatgcggccccctgtgccgactgtgccaaggctgggacggaccctgctccaggacactgaagtgggggagggggagatgtattcacacaaggacttatgagctagccggcatcaggtggcatggacagttgacccaagaggatgctctcccactccattttggttttccatgggagaatcctggaaacagcactgttgctgtgacattctccttattcaccattaactgagagcaccatgggcgtgcctgggaatgagcagaaagttagatcctttttggaggtgcaaggtgagaaaggggagaaatctgtgttctctgagacatctccttacctgctttgctttatagctgagggccttgcctgcgacactctgtgggatgtgtgtgggcgtaggtagttagacacacacacacacacacacacacacacacacacacacggcggcggggggaggggtggtggtgggtaagggtggagagagagactcctgcttctgggtgggaacagggtgccagcgtgaattggcactgtcctattgctatgatgatgactttttcctccctgcagctctggagcacttggaagcggttctgaagctcatttgcagctttgcatctgtttgcacgggcgtctcctgctgggagttgaggcttcctgccctcattggctgtctgaggctgcgctccctacctgcccgcagcgtccctgccccccacatccacccccagtagtgtaatgggacagctcctccctcgagtgctttgccgaaggggacctgcaagaacccaaaacagcagcgctgcagccagggcggtgccttctcctttcctctgtttcctgggctccaggagaattctgtcttggggtccgagaaaaactcacacagcagaccggctggcccagggctgactcagtgtttctttctctctctaggaaggcctggctggaaccagcacattttgtggaagtgggaaccaatacacgtgtacacttctctttacagggcacgctatcatcactaactacttgttgaactatttccctggtcttgaccttgaaaggaggaacgcgttcgggttcaccgccctgatgaaagccgccatgcagggtcgaacggactgcatccgagccctgatgctagcaggtatgtccacctgtcctgtgcagcttccaggggccctgggacaccagagttgctcctttatggaatatgttttgagattaatcactcccatagaaacaatgcctagttgctgcaataaataatagtttcttcactgacatatacttctgtaactatctgaggttttaaaaaagccacagcattggttcccttcaggacacccctttctgctccctgctgagctttgcagtgggtggcaccttccctcacctgctgttttcctcctgcccacccgttctacaccccaagtcctgtccatatctgttcctcctcagaaaggggtgatcccttggctgtaaatggcaagactgtgctgttgaaggtgggcgtagggatggtgggaacggcccaggccatcctaggtcactgcttgctggtgggtggcattgcatagtaacgttaggaggtgatgtggagttgcatgttaatgttgggatgtgatgtggagttgcatggtaacgttgggaggtgacgtggagttgcatggtgacgttaggaggtgacgtgttgcatggtaacgttagaaggcgatgtggagttgcttgttaacgttaggaggcgacatgttgcacggtagcattaggaagtaacatggagttgcagggtaatgttaggaggtgatccggagttacatggtaacattaagaggcaatgtggagttgcatggtaatgttagcgggtgacgtggagttgtgtggtaatgttagcgggtgacgcggagttgcgcggcgatattagcgggtgacgcggagttgcacggcgatgttagcgggtgacgcggagttgcgcggcgatgttaggcggtgacgcggagttgcgcggcgatgttagcgggtgacgcggagttgcgcggcgatgttagcgggtgacgcggagttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgcgcggcgatgttagcgggtgacgtggggttgcgcggcgatgttaggcggtgacgtggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgcggggttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgcgcggcgatgttaggcggtgacgtggagttgcgcggcgatgttagcgggtgacgcggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgtgcggcgatgttagcgggtgacgtggggttgcgcggcgatgttaggcggtgacgtggagttgcgcggtgatgttagcgggtgacgcggagttgcgcggcgatgttagcgggtgacgtggagttgcgcggcgatgttagcgggtgacgtggagttgcacggtgatgttaggcggtgacgtggagttgcgtggtaatgttagcgggtgacgtggagttgcgcggtgatgttagcgggtgacgtggagttgtgtggtgatgttagcgggtgatgtggagttgcgtggtaatgttaggaggcaacgtggtattgcatggtgatgtgtgtggcaatttccgttttctatgctgtgtcatagagtggaaaattctcaggctatcaacctggatcaacccctctttgtcttttgcgccatcttggagaacgcactttcctgttcccatctgtgaaatgggagtaatgacctctttctccctcacctccctgaggctaaaatgcaacaatactttatacactcctagaggctatccagcttcaatgagctactaagctaaatgccacacaactaatagctttaactcttttcttcactctgaaatagaatcaatgatcatccttcgtgcaacctcatcgggttattttgagaattaaatgagaaaatatgtgtcaagcacatgtcgtgttagattcagttagcagctgacatctcagtgaatgtgcgatgctgctttcaccattacttaattctgttattttaatttctctttatttttgttcttggcactgggttcagccagtcctgcttggcgctgcaagttcctgaagaagtggatttcctctctgtcttagttgttctgctgctataacaaaatacctcacctgtgtaatttgtaactgtagaaatttattgctcacacttggggaggctgagaagtccaagatcaaggtgccggcaggttcgatgtctgctgatgccccttccttcttactgtctcctctcatggcagaggggacaccgaggtaccctcaaaccctctttcataaggcactagtttgattcaggagggcacagccctcatgatctaatcaccccctaaaggcctcacctcttaatactattccagtgggtctgaagttccagcataggaattttggagggtcgtcaacattcagaccacagcaccacccctgtcttggttatcctgagggtggcatcagagttttcccaggcatcagtgcttccattaatgtcacttttctgttccaggacccctgctgggctcccacatttagttgtcttcttcttagttgtccccagtcttcttcttcttcttctttttttttttttttttttttttgagacagtctcactctgtcgcccaggctggagtgcggtggtgcaatctcggctcactgcaacctccacctcccgggttcaagcgattctcctgcctcagcctcccgagtagctgggattacaggcacctgccaccacgcacagctaatttttgtatttttagtagagacggtgtttcaccatgttggccaggttggtcttgaactcctgacatcccgtgatctgcccgccttagcctcccaaagttctgggattataggtgtgagccaccgcgccctgcccctcatcttcttgggtctgtgaagtttctgtcataacctgttgcccatgacgggacagtcttgattccaaccagtgtgcagcaccgcccagtctgagcccgtctgttgtttttctcgagatcaatctggagttacaggattcacaattgcttcagatttatctttctttttgctttaaccttaggggattctttagtcttaggagatgctataataaaaataagttcagtgaatgagaatagaggcttcaaagatgaaaactttcttggaaataaaaaaaaaaacataattaaaaacgagtcctatcgattgtacttttgattcagagatgatagttttattttaaaaaaacgagatatcagtttcaacagagtttcggccctgcctgccctcatcaatgagaaatggttcctactaattaaatggtaattatgtgatgcttttgtgtttggcgggagcttcagacacttttactatttctggatctagttataattgggcgtagatgtttggtaattgactttttcaactgaacatttatgatgtcagtcacatcactgcactttcccattgaattaatttgaactgcaaaccttttttaggtcagttgccctctaatcgctccgtttgactgccgtgctttcttccctgggtctcctgggggtttcaggcatgtgtgacagcatttagaggattccagaaacaccttgcacatctcttggaacgatgagtctgcgggcagtgggtttactgctgacattgctcttcccccatcagttatttggatacaaatttgacattagatttgagactctccctcccctattctccactttgcaagcccatcccccatcacagtctagaacaatccacggattattgtctgtgggatcctctagtgagtctctccctgtcctatacgaggtacagagcaggagctgaacagaaacagtccaggaaccaggacccagtttcaaattcatcttctccacttcccatctctacacctgcagcctgtcactcacctctctgggccccagtttcctcttctataaaatgaggctaatgatagcacccaccgcaggaaggtgggatgcggattgggcacgttcacaacagaacagccctcgggtgcatgctgggcttggagaagccttcggacatgttggttgtgattattgttattattatgattattggtgagtttatgtgttcaatagttatctgttaagtgaatgaaaaaatacggtttgtttttccctttgagaaatatcttgtaaatgagatacttaaactttcttaatgagggtagtaagcccctacctcagggtttttgttttttgcttttttgttctgtttttgtttgtttgttttgctttgttttgttttgttttgagacggagtctcactctgtcgcccagagtggagtgcagtggcgcgatctcggttcactgcaatctctgcctcctgggttcaagcaattctcttgcttcagcctcctgagtagctaggactacaggcatgcaccaccacatccagctaatgtttgtatttttaggagagacagggtttctccatattggccaggctggtctcaaactcctgaccttgtgatctgcatgcctcgtcctcccaaagtgctgggattacaggtgtgagccaccgcacctggccaggggtttcttaatttcagcactactaacatgcagagccagataattctttgttgtgggggctgtctttcaaattgtaggatttttagtggcatccctggcctctacccacaagatgactgtagcacctcttcagttgtgacaaccaaaaatgtctctagatgttgctcaaagtctcccaggttgggggaaaaattgcttcccatcgagaaccactgatataaataatttaaatgggaaaggatatacaaagtgagaagagacattttcccctctgtgtactcttcctcgcttgttctgtattcctccctcaaataaaagtgtgacatcttggccgggcatggtggcccacgtctgtaatctcagcactgtgggaggctgaggcgggtggatcacctgaggacaggagttcgagaccagcctggccaacatggtgaaatcccgcctctactgaaaatacaaaaaaaatttagccgggcatggtagcacaagcctgtaatcccagccactcgggaggctgaggcaagagaatcgcttgaacctaggaggcggaggttgcagtgagccgatatcatgccactgtattccagcctaggcaacagagtgagactctgtctcaaaaaaaaaaaaaaaaaaaaaagagaagtgacatcttgtttagggaacttttgagctgccctcttaagctttggttgtagtgtagaacttacggaatattttcatcttctactattactactaagcttacagttctcccaagaaaagtgggttttattttcctttgacagtagatgggtaagaattaaaaaaaaaaaaaaaagtgttgaattgcttccccaggattagtggagagcaataaggacagatgttgatatatttctaaaattcacacaaatattttaagtcttattctttccatttaaatacgtgatattaagaaaaaaataaaccatttaaagaaactaatagccagagcctttcttttagattgacacttcagattgtaataaaaagtataaccgggttctgagaggctgatcgattgcatctttggtttggcttcgtaaggagtaatgcaggctctgctgaagagcatcacaagggagttgcagaaccttgttaattcactgaaatattaatgcccacagtgacaggtctatttaaataggtggctctgagaagcgtatcgaggatgtgatttttttctgaagagaggcagaatctgtggaggttgccaggttccaggcttgcttaagggagctcactttcagacctgaagtgtggtgtaactgccgcagccttcaggaagcaaaaacaagcagcaataacctcaaatcttcctgtgattccaaggcgcaaagtggatttaaaggacggcgaggaacagagatcagagatgctcccgctgtgggtcagagggttgctcttgtctcagggaagccctgatatctctttctggaaagtcagatgatttccaaccatatagaggtttctttctgtttataaggaaaacttaaatttcctatgaagtgtgaatttgccatgtagaattgtttgaagtcattagccagagaaaggatgaaaagtcaagcattctgtgtcacctgcaaagcaaacctcgagacaaggacttgggggcaagtagttttgagggatggtggccccaggaagtggagtgagggggcagcaagtgagattgggaagaatggaagctaagaaatgtccaccaatgagcaggttcctcttgtgggcagctgggactcagaccccctggaccctccactatgaggaaaagatatcgcagagatgctgggaagtttatttcccaactccagtgcctctttgaggggagatgagaactttgagcacacttcccacctgctatgtggtgggggtggcttgtcctccctgctgggctggagcacaagctctttcttggaccctgcatccagatttgtcatcccgattatacccacaatgcccaagatacaggctggaggtggcacaaggggaggcagtgagggctggtccacagtggtctcctgtggccaggaaaggccccctggcaagagggagacctgagctagggtttgtagagtggataacatgggggtgggtgggggctggtggagaagcaggaaaggaagtgacacattcagggcttcacgctccacccacctcctgctagtcctgggcctggccatggctcccagagaaagccttcttgagaatgagtgatggaaagtatagatttttttttcccattagcacctgtttggaatgtttttggctgcaagtaacagaaatcctgactagacagtggcttaaagaaaacaggccgcatttctcagctccctggaagtctgaggttggcagtcaccctccagagctggccctggattccatgaggacaacagtggtttcctcctgtccatttggctccccttagcctgttgatctgtcaccccttgattccacgagaatcacccaatatgtgtttcagacaggaagctgcagcagcaccaaccatgctggtccctttcgtcaggaggcagaaccctctttagggctcagtcaccagtgctgggttgcttggctacttttagctgtaagggaggctggaagaatggggaacaggattgcagccgttagattccaatagtgattctcagctggaggtaatgttgccccaggggacatttggccacgtctgtagacatttttggttgtcagaactggcggactgctactggcatctagaagaaggtagagatcagggatgccgttaaatgttctccaatgcacaggacagcccacaccaaataattacctggcctaatatgtcaacagtgctgaggttcagaagtcctgggttagactgatcgtgatgcattgccaagaactgaggatgttgctgcctcaagtgaaatagaggattttgtgtagacttagagcactcaacaaggcagcgagtggacccatgggtggcagctccacttttgtccacatgattgagccctgggcaaaacaacactgggtgggagatgacgatgctggggggtctgctggcgagaagatggatacagtggcatttcagaaatcctctgtattctctggaaggtatttgtataaaatgttaataatcggtacttatcttttataatttaattgctgtgttcatgtcattaatataaccctttacagttgcttcctaaggcagcagatccctaatttatagcatgactctgattctagggctcagtggcctttgttccttagaatgtttgtattttctgagatcattttgaaaagataggtgaacatcaggacgaagagtgcaaaactttggacagatcttcctctggttttccattagcatttgaaaaatgtctctttcaggcagtgttcattaagattttaattttatagtttgttccttttttaagtgacatgcaattaattaaggtttaatgtgtcatctattttttgcaatgacacttttactgcccccttttcattttagtcagtttataaattgtactctagctaatgagttccatcctgatat

SEQ ID NO: 12 - DNA, 5260 bp, Homo sapiens
agagagtgtcattagcaacagtgagagtagatggatctggaattggactgaagcggagttgaatggttgatggagggtggcgggaacatgaagacggcccacaggggttgctgtgagtcacatatgcttttaagatgagagacccttgagcatgcatgtcagctagttattgctgtgtaacaaacaactcccatgctctgggatgtttttattgcttatgcatctgtggatgggctggggatctgttgatctaaactgtccttgctcaagtctgtgggcaagtcggggacctgttcttgggcacttcggctggggcagctctgctgcatgcattactcatcctcttcctgggagcagcgagccagcctgggcatgctcttcttggggagacagctgaggcacaaacatgcatgaaagtctggataagtacatttcaaccttctgcttccatcacgcctgcaaacatcccatcggccaaggttccactagacagagaactgggaagtcacttaacaaagggcagtgtgaagaagatgggccattagtgcattgtaggaactaagggccttctgaaggttcactaaaatcaacttgcaaaaggcaggtgaataagagaagaggcatacaaaagaggccatgttcccataacatgcgtacatgggagccttcggaatgaaaacccaaaaatgcaggaggaattttccatttttctgcttaggttcaacaaagtgtggacagttatgtagaaatatagttggacaggccaggcacggtggctcatgcctagaatcccagcactttgggaggctgaggcaggagaatggcttgaacccaggaggctgaggttgcagtgagccaaggtcgcgccactgcactccagcctaggtgacagagtgagactgtgtcaaaaaaaaaaaaaaaagaagaagaaatataatgctaataaatagactgagtggggaaaccccacaggcctgcctgtctcctcgattcttctaggtttctctgagcagcacttcttccttctgggagtgactctccctggaacaggggtcttatgacctacagtcggacatggcaagtcagataatttctttatgttagggcagtatttttaggttttagggaacctttaggctggccttagggaaaaggggttctggtttcaaagatctgccttggggaagagggattccagtttggatggctggcctcagggaagaagggactgagacatgggagggcaggagggcagagagaaacctttgcttctgaggccttcactgtggggtattgctttctgagccccaacagcattctgagggaagtgggtctgcaaggaatgagaggttgatgagaaacaggagggatctgataaatattccacagcagtgggcagggagtggctgtcaagcacaggaggggaggagcagggataagcctccttcagcaagaggagaatcccctgcgttttcaataggaaaagtgaactgaggattgacgaggttcataaacttggaaagaagagctttcttctcataaagggttgcagcctgcagggtggctattgtggcagggaagcagcgcctctggccagaagccagaaacagacccttccaggggcagaagaacaagacagaagaacaatgcatgctgaaggaggtggctcaatacacatattccataagctatgggagaagcattgaatatcgatgagaggagaaacacgcaagtgtgcaatcgagctccgtgcctctccctgggacctgtgttcaaaaagcaacagcgttagcatgatctgagggtggagttttcaggccctgacctcaaaaggtgaagcagaggacatgaaaaccctcactgcgcgtcctctgtggacctgccggacgcactccaaagccatggccagtgtctctcatgaggacggaatgctggtcggttgtttcatccaaattgcagaacggcggggcagcatcaggcggttggtttatatcagtggaggagtctttagaacgggctggtttctgtttagacttaggaaagaaagcctcacggttagcaaggaatgggtataacgaggcgcattgcccttccatcctgtcatagccaggactcagttttcaagggttctctggggtccccttgggcaggagggggtcggttcagtccgttggatggctcaggatttcacttttccttctcggaggcccgtgaatgtgggcagcgtggggggcgatgggggaaagccgagggacttcccttctggtggtttctgttccctctatgaacttgaagatgagtcatccaggagaggggtttgcgtgaggtcggtgacttccatgtgaaaaatttaacattttccccatggggcctggggaagagtcaaccgggaagcacaggagcactgctggggcaggctgagaagccggtcgggcccgggtggcgtgggtgtccacctctttgtgtcccccaacgaaggcaccttcgcatccatgcagagcggaaccaggggtgtggcggggccaggcgtcatttccagctttcctcttttgcataccacagacctgtccatccactcatttaggagctctctgaatcaagcactcctctccctcctcctgcccggggttgggggctgggctccatctctgcctcctgaatgctcccgtggcttcctggtgagctccccaccactgggagagcctcaggtccagggtggagaggccccacaccaggccgcacagccagctgtgaatcatggtcctgaccttgcactctttttgaacggctctatgctagtttccccttttttatttttatttttatttatgtatttattttgagacagtgtcttgctctgttgcccaggctggagtacagtggcatgatctctgctcactgcaacctcctcctcctggtttcaagtgattctcctgcctcagcctcccgagtagctgggattacaggcacccgccaccactcccagctaatttttctatttttagtagagatggggtttccccatgttggccaggctggtcttgaactcctgacctcaggtgatccacccccctcagcctcccaaagtgctaggattacaggcgtgagccaccatgcccagccagttctcctctttttttttttttttttctttttgagatggggtcttgctctgtcaccaggctggagtgcagtgatgcaatcttggctcaccgcaacctccacctcctgggttcaagcaattctcctgcctcagcctccggagtaactgggactacaggtgcacgccaccacgcccagctaatttttatatttttagtagagatggggtttcaccatgttggccaggacggtgtgatctcttggccacgtgatccacccgcctcggcctcccagagtgctgggattacaggcgtgcgccactgcgccaagcctatctcctctttttttaaaataaacttttgatttgagaatagtttatgtttacagagaaaccacaaacactgtacagagaatgcctgtgtgcctcacactggttccctctgttgttaagatctgacgtccgtgacgcgctgaacacaatgaatggacgcgtgtcaattcaccattattaactgaagtccgttctttattcggatttcctcagcgtttcccggatttcctttttctgttgcaggatcgcatgtggcatttagcactcatggctcctcaggctcctcttggctgtgagcttctcagacttctcttgtttttcatgacctcgacagttttgaggaggactggtcaggtacattgcagaatgttccttaatttggacgtgcctgatgcttttcttgtgatgagactggagttatgagtttttggaggaagacgcccgataaagggctgatgggccttggtcacctggctgaggtcatgttagcagatttctccactgtgaggttctctccctcctcccccgtttccgtgtaatagtctttcacaggaagtcagtgcacgcagcccgcgggttaaggaggggggaacacgttctagccccttgagagtggagtgcctgcctggattattcagaatttttcttccagatttttctattctgctgggcaccttttacacacagattgtctcctataattttcacaaatgggaggttgatattatccctcattttacagatatggaaaagctgacttccaaaagacacccggattctgagtggcaggcctgggccttgaacctggctgttctcagagccagctctcttcagtactgagctcattgtctacactatgttccagtgacgcgatttcattcaaattcacttcctccctgggtcacttgtgaccctctcttaagcagggtagggcttattggtggagagggggtgttctggggttctctaggtgaacctaccctttaaaagggcttctctgaggatttcaggaaccaagtccgattccataatgtccaagttggactgggctcaaactagatttttttcttttttttttttgagacagggtctcactctgtcgtccaggctggagttcagtggtgtgatcttagctcactgcaacctccacctcctgggttcaagcaatgctcctgcctcaacctcctgagtagctgagaatataggcatgcaccagcacacccagctaatttttgtatttttagtagagacaggcactatgttgcccaggccggtcttgaactcctggcctcaagtgatctgcctgccttggcctcccaaagtgctgggattacaggagtgagccactgcacctggcctcaaactagatttcaatatggcgtgtgtttgggttcccttgtgcaaggaaggctgtgtgtctcatatatgtaaagaaaaggaaagctccttttggttactcatcatggtttttaaagaagaaaggttaatacttatacattcttagaagtattgggtccacctttgatttccattgaatggggtcatctgtgtgatgagaggtattattctgccatcctgggaaaacccgtgggaagcagggcgtgatttcttggatcatcgaaagctcaggcctgtagtcagaacaagttgactgcatgttggtttttctggactcaacataatacgcagaacagatctatataatgggtggtttgctctgtggactttgagtttttcctctttccacctgttcaaagtgctgaggatatatcagtgcaaaggaacatcctgcagaagattgtgacggacacgctatttcacagttta

(The sequence listing continues in the following parts.)

What is claimed is:

1. A method of hybridizing a nucleic acid probe comprising:
   (a) hybridizing the nucleic acid probe to a polynucleic acid from a human subject by nucleic acid hybridization or microarray analysis, wherein the human subject has Autism Spectrum Disorder; and
   (b) detecting a genetic variation in the polynucleic acid by the nucleic acid hybridization or microarray analysis, wherein the genetic variation is a CNV, wherein the CNV is the loss of SEQ ID NO 592, SEQ ID NO 593, or the complements thereof, in the ATXN2 gene.

2. A method of synthesizing a nucleic acid product comprising:
   (a) synthesizing the nucleic acid product from a polynucleic acid from a human subject by PCR or sequencing, wherein the human subject has Autism Spectrum Disorder; and
   (b) detecting a genetic variation in the polynucleic acid by the PCR or sequencing, wherein the genetic variation is a CNV, wherein the CNV is the loss of SEQ ID NO 592, SEQ ID NO 593, or the complements thereof, in the ATXN2 gene.

3. The method of claim 1 or 2, wherein the CNV is loss of SEQ ID NO: 593 or the complement thereof.

4. The method of claim 2, wherein the nucleic acid product synthesized from the polynucleic acid is cDNA.

5. The method of claim 1 or 2, wherein the polynucleic acid comprises a nucleic acid from blood, saliva, urine, serum, tears, skin, tissue, or hair from the human subject.

6. The method of claim 1 or 2 further comprising purifying the polynucleic acid.

7. The method of claim 1, wherein the microarray analysis is selected from the group consisting of a Comparative Genomic Hybridization (CGH) array analysis and an SNP array analysis.

8. The method of claim 2, wherein the sequencing is a high-throughput sequencing method.

9. The method of claim 1 or 2, wherein the whole genome or whole exome of the subject is analyzed.

10. The method of claim 1 or 2, wherein the CNV is loss of SEQ ID NO: 592 or the complement thereof.

* * * * *